US011473100B2

(12) United States Patent
Fahima et al.

(10) Patent No.: US 11,473,100 B2
(45) Date of Patent: Oct. 18, 2022

(54) STRIPE RUST RESISTANCE GENE WTK1 (YR 15) AND USE THEREOF

(71) Applicants: CARMEL HAIFA UNIVERSITY ECONOMIC CORPORATION LTD., Haifa (IL); NATURAL RESOURCES INSTITUTE FINLAND (LUKE), Helsinki (FI)

(72) Inventors: Tzion Fahima, Kiryat Tivon (IL); Abraham B. Korol, Haifa (IL); Lin Huang, Chengdu (CN); Dina Raats, Mazkeret Batia (IL); Valentyna Klymiuk, Mariupol (UA); Zeev Frenkel, Haifa (IL); Alan Howard Schulman, Helsinki (FI); Elitsur Yaniv, Vantaa (FI); Andrii Fatiukha, Mariupol (UA)

(73) Assignees: CARMEL HAIFA UNIVERSITY ECONOMIC CORPORATION LTD., Haifa (IL); NATURAL RESOURCES INSTITUTE FINLAND (LUKE), Helsinki (FI)

( * ) Notice: Subject to any disclaimer, the term of this patent is extended or adjusted under 35 U.S.C. 154(b) by 0 days.

(21) Appl. No.: 16/758,161

(22) PCT Filed: Oct. 3, 2018

(86) PCT No.: PCT/IL2018/051081
§ 371 (c)(1),
(2) Date: Apr. 22, 2020

(87) PCT Pub. No.: WO2019/082175
PCT Pub. Date: May 2, 2019

(65) Prior Publication Data
US 2020/0291419 A1    Sep. 17, 2020

Related U.S. Application Data

(60) Provisional application No. 62/575,688, filed on Oct. 23, 2017, provisional application No. 62/575,670, filed on Oct. 23, 2017.

(51) Int. Cl.
*C12N 15/82* (2006.01)
*A01H 6/46* (2018.01)
(Continued)

(52) U.S. Cl.
CPC .......... *C12N 15/8282* (2013.01); *A01H 1/04* (2013.01); *A01H 6/46* (2018.05); *C07K 14/415* (2013.01);
(Continued)

(58) Field of Classification Search
None
See application file for complete search history.

(56) References Cited

PUBLICATIONS

Zuo, et al. "A maize wall-associated kinase confers quantitative resistance to head smut". Nature Genetics. 47, 151-157. (Year: 2015).*

(Continued)

*Primary Examiner* — Matthew R Keogh
*Assistant Examiner* — David R Byrnes
(74) *Attorney, Agent, or Firm* — The Roy Gross Law Firm, LLC; Roy Gross

(57) ABSTRACT

Isolated DNA of the Wtk1 gene or a functional equivalent capable of conferring resistance to stripe rust, is provided, as well as artificial vectors comprising same, proteins encoded by same and nucleic acid molecules for detecting same. Transgenic plants, as well as cells, seeds, and tissue therefrom which express the Wtk1 gene or a functional equivalent thereof are also provided.

Figure 1:
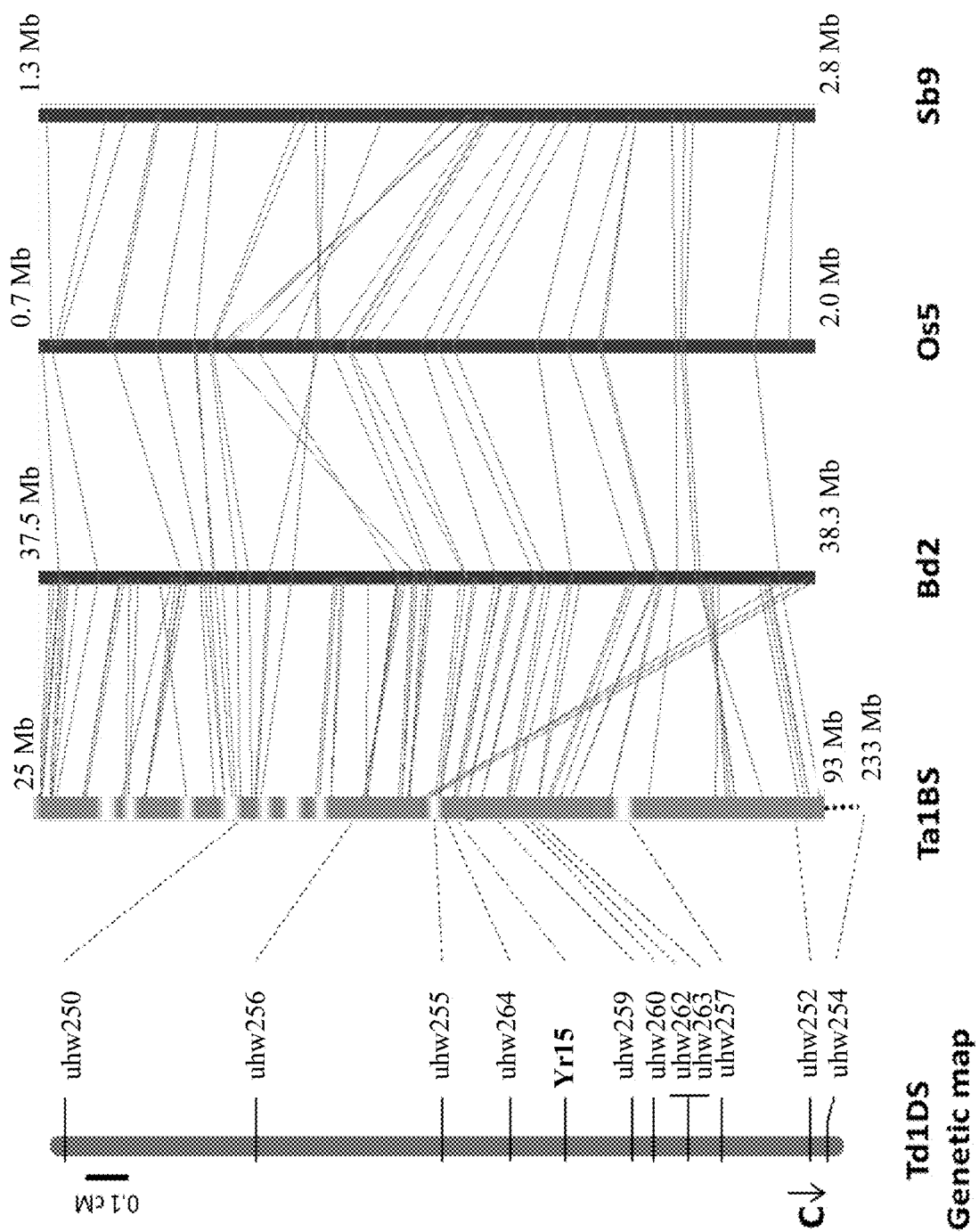

14 Claims, 42 Drawing Sheets
Specification includes a Sequence Listing.

(51) Int. Cl.
  A01H 1/04    (2006.01)
  C07K 14/415  (2006.01)
  C12Q 1/6895  (2018.01)
(52) U.S. Cl.
  CPC ....... *C12Q 1/6895* (2013.01); *C12Q 2600/13* (2013.01)

(56) References Cited

PUBLICATIONS

Database NCBI [online], Feb. 24, 2017 (Feb. 24, 2017). Predicted: *Aegilops tauschii* subsp. *tauschii* putative wall-associated receptor kinase-like 11 (LOC109773552), mRNA. GeneBank accession No. XM_020332242. URL: https://www.ncbi.nlm.nih.gov/nucleotide/XM_020332242.1?report=genbank&log.

Database NCBI [online], Feb. 24, 2017 (Feb. 24, 2017). Pputative wall-associated receptor kinase-like 11 [*Aegilops tauschii* subsp. *tauschii*], GeneBank accession No. XP_020187831. URL: https://www.ncbi.nlm.nih.gov/protein/XP_020187831.1?.

Yaniv, E. et al., Evaluation of marker-assisted selection for the stripe rust resistance gene Yr15, introgressed from wild emmer wheat. Molecular breeding, 35(1), 43, 2015.

Uauy, C. et al., Wheat genomics comes of age. Current opinion in plant biology, 36, 142-148, 2017.

Sanchez-Martin, J. et al., Rapid gene isolation in barley and wheat by mutant chromosome sequencing. Genome biology, 17(1), 221, 2016.

Moore, J. W. et al., A recently evolved hexose transporter variant confers resistance to multiple pathogens in wheat. Nature genetics, 47(12), 1494, 2015.

Klymiuk, V. et al., Cloning of the wheat Yr15 resistance gene sheds light on the plant tandem kinasepseudokinase family. Nature communications, 9(1), 3735, 2018.

The Cloned Yr15 Gene (Wtk1) Encodes Two Kinase-like Protein Domains, Both Required for Conferring Broad-Spectrum Resistance to Stripe Rust. Abstract W1041. Jan. 13, 2018, Plant & Animal Genome Conference XXVI, Jan. 13-17, San-Diego, CA. URL: https://pag.confex.com/pag/xxvi/meetingapp.cgi/Paper/30233.

Abdollahi Mandoulakani, B., Yaniv, E., Kalendar, R., Raats, D., Bariana, H. S., Bihamta, M. R., & Schulman, A. H. (2014). Development of IRAP- and REMAP-derived SCAR markers for marker-assisted selection of the stripe rust resistance gene Yr15 derived from wild emmer wheat. Theoretical and Applied Genetics, 128(2), 211-219. doi:10.1007/s00122-014-2422-8.

Fu, D., Uauy, C., Distelfeld, A., Blechl, A., Epstein, L., Chen, X., . . . Dubcovsky, J. (2009). A Kinase-START Gene Confers Temperature-Dependent Resistance to Wheat Stripe Rust. Science, 323(5919), 1357-1360. doi:10.1126/science.1166289.

* cited by examiner

| Line | Latin name | Nb 1 | Nb 2 |
|---|---|---|---|
| 695 | T. dicoccoides | Allele 2 (Wtk1) | Allele 2 (Wtk1) |
| D | T. durum | Allele 2 (Wtk1) | Allele 2 (Wtk1) |
| D10 | T. durum | Allele 2 (Wtk1) | Allele 2 (Wtk1) |
| 4801 | T. durum | Allele 2 (Wtk1) | Allele 2 (Wtk1) |
| TC1057A/T15 | T. aestivum | Allele 2 (Wtk1) | Allele 2 (Wtk1) |
| Avocet/T15 | T. aestivum | Allele 2 (Wtk1) | Allele 2 (Wtk1) |
| Lycabbur/T15 | T. aestivum | Allele 2 (Wtk1) | Allele 2 (Wtk1) |
| Sunco/T15 | T. aestivum | Allele 2 (Wtk1) | Allele 2 (Wtk1) |
| USU3177 | T. aestivum | Allele 2 (Wtk1) | Allele 2 (Wtk1) |
| USU2929 | T. aestivum | Allele 2 (Wtk1) | Allele 2 (Wtk1) |
| Zavitan | T. dicoccoides | Allele 1 (wtk1) | Allele 1 (wtk1) |
| DV1 | T. durum | Allele 1 (wtk1) | Allele 1 (wtk1) |
| Strongs | T. durum | Allele 1 (wtk1) | Allele 1 (wtk1) |
| SY651 | T. durum | Allele 1 (wtk1) | Allele 1 (wtk1) |
| Tempalo | T. durum | Allele 1 (wtk1) | Allele 1 (wtk1) |
| C | T. aestivum | Allele 1 (wtk1) | Allele 1 (wtk1) |
| TC1057 | T. aestivum | Allele 1 (wtk1) | Allele 1 (wtk1) |
| Avocet S | T. aestivum | Allele 1 (wtk1) | Allele 1 (wtk1) |
| Lycabbur S | T. aestivum | Allele 1 (wtk1) | Allele 1 (wtk1) |
| Sunco S | T. aestivum | Allele 1 (wtk1) | Allele 1 (wtk1) |

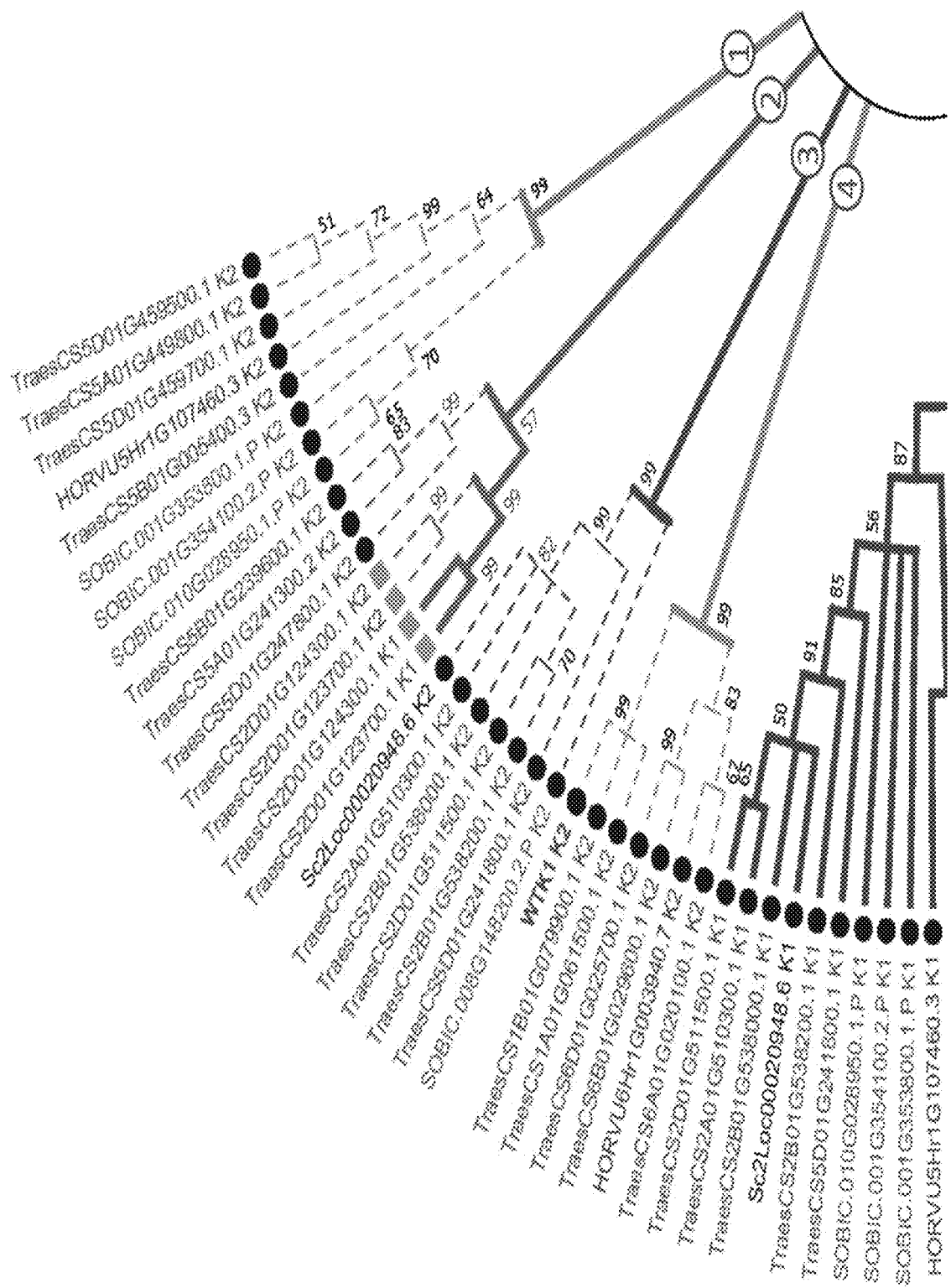
Figure 13A part 1

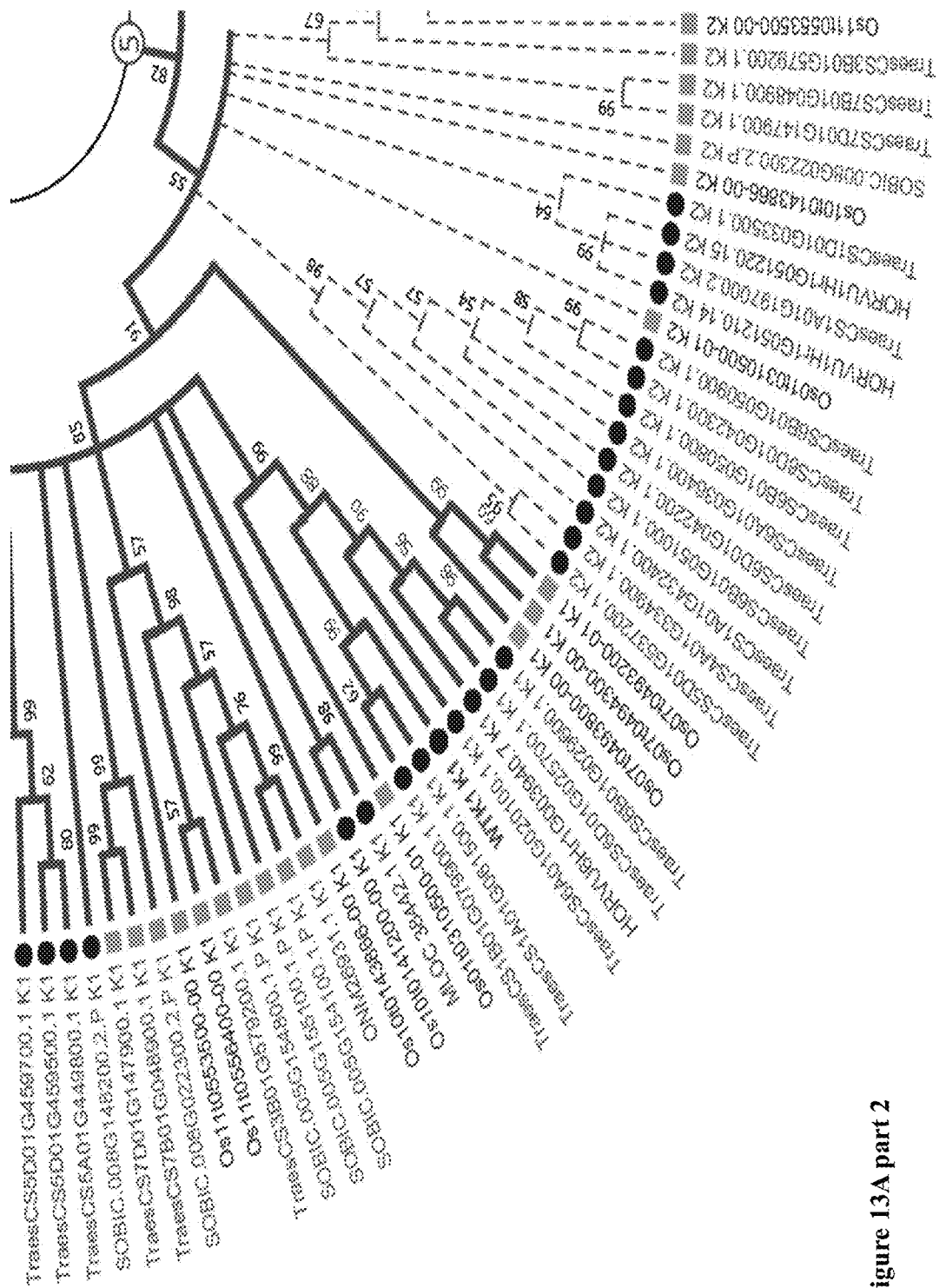
Figure 13A part 2

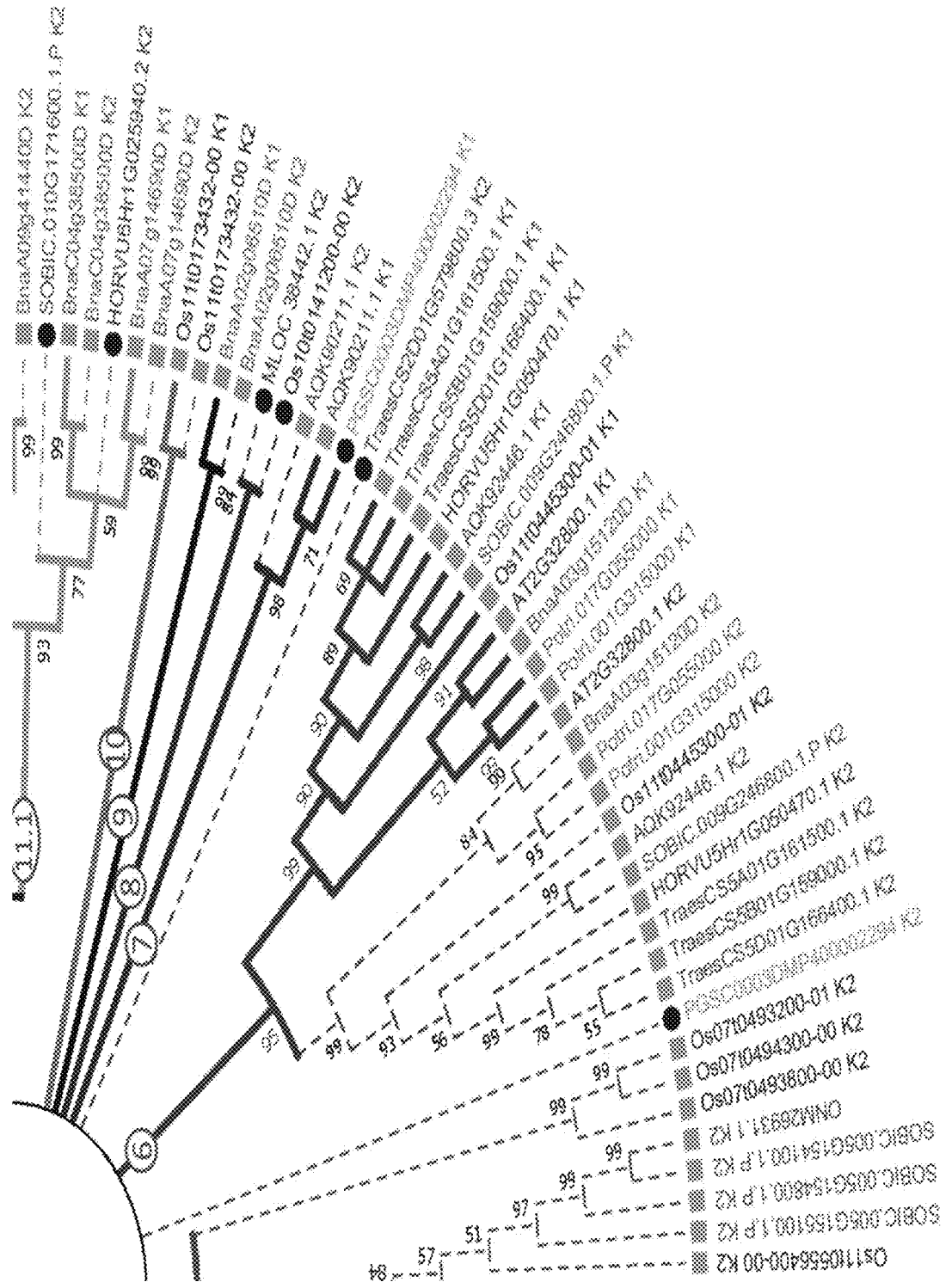
Figure 13A part 3

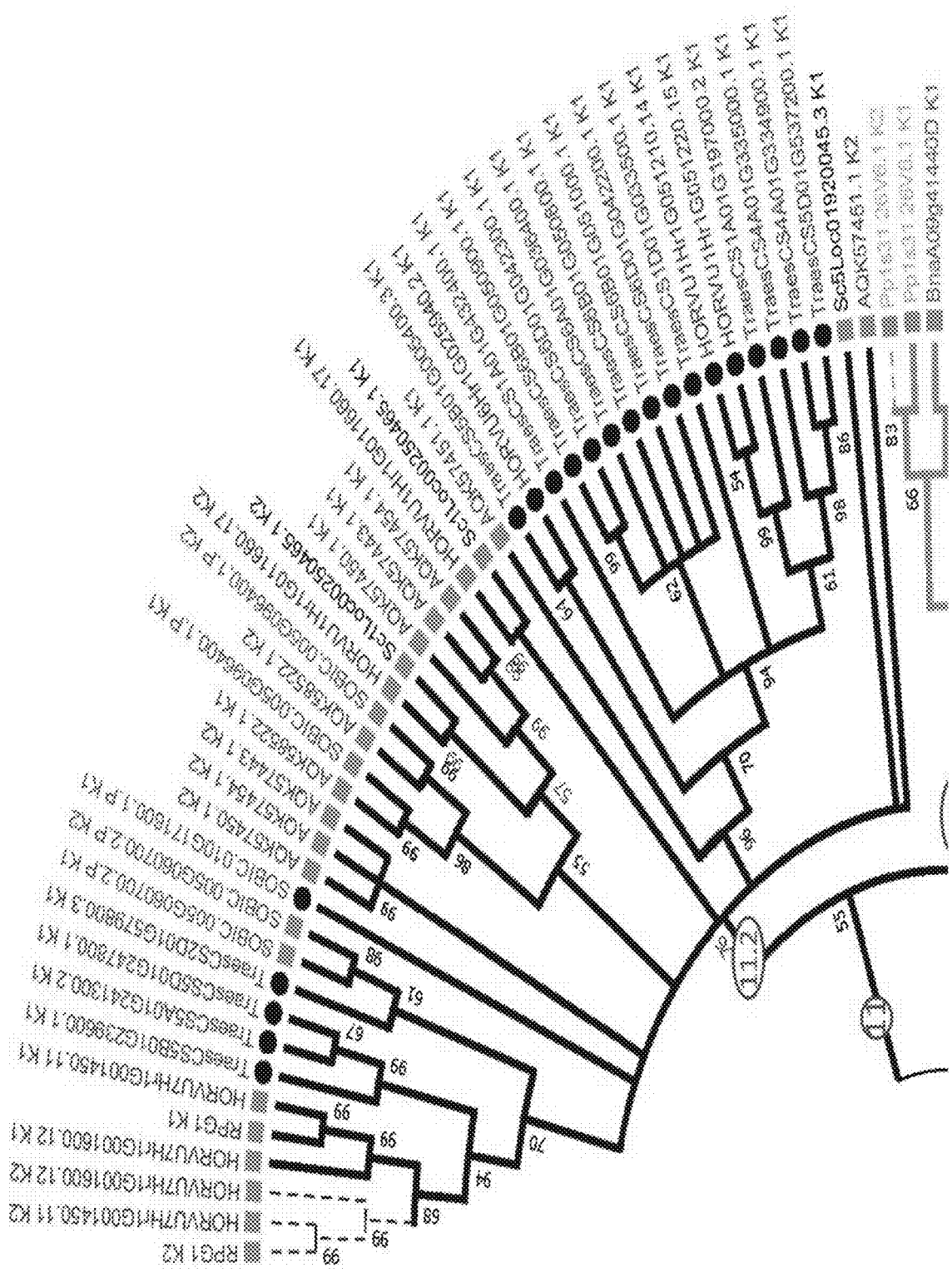
Figure 13A part 4

1) LRR_6B (leucine-rich-repeat receptor kinases subfamily 6B)
2) RLCK_7 (Receptor-like cytoplasmic kinases subfamily 7)
3) LRR_3 (leucine-rich-repeat receptor kinases subfamily 3)
4) RLCK_8 (Receptor-like cytoplasmic kinases subfamily 8)
5) WAK (cell wall-associated kinase)
6) L-LPK (concanavalin A-like lectin protein kinase)
7) RK_1 (other kinases with no published family)
8) RK_1 (other kinases with no published family)
9) RLCK_7 (Receptor-like cytoplasmic kinases subfamily 7)
10) LRR_12 (leucine-rich-repeat receptor kinases subfamily 12)
11.1) Soluble kinases
11.2) LRR_8B (cysteine rich kinase)

Duplications
Fusions

Figure 13A part 5

Gene duplication events

RLCK_7_RLCK_7
LRR_6B_LRR_6B
LRR_8B_LRR_8B
LRR_12_LRR_12
MAP3K-rel_MAP3K-rel

AGC_AGC
CDK_CDK
RK_1_RK_1
WAK_WAK
L-LPK_L-LPK

Gene fusion events

LRR_8B_MAP3K
WAK_LRR_3
WAK_LRR_6B
WAK_RLCK_8
WAK_RK_1

LRR_8B_L-LPK
LRR_8B_LRR_6B
LRR_8B_RLCK_7
LRR_8B_SnRK3
LRR_8B_WAK

Figure 13B

Figure 14

DK92/02 (*Yr15* virulent)

AU85569 (*Yr5* virulent)

Avocet S  Avocet+*Yr15*  Avocet+*Yr5*  YecoraRojo*Yr5/Yr15*  Patwin*Yr5/Yr15*  Summit*Yr5/Yr15*  Dirkwin*Yr5/Yr15*

US 11,473,100 B2

STRIPE RUST RESISTANCE GENE WTK1 (YR 15) AND USE THEREOF

CROSS REFERENCE TO RELATED APPLICATIONS

This application is a National Phase of PCT Patent Application No. PCT/IL2018/051081 having International filing date of Oct. 3, 2018, which claims the benefit of priority from U.S. Provisional Patent Application No. 62/575,670, filed Oct. 23, 2017, and U.S. Provisional Patent Application No. 62/575,688, filed Oct. 23, 2017. The contents of the above applications are all incorporated by reference as if fully set forth herein in their entirety.

FIELD OF INVENTION

The present invention is directed to the field of plant genetics and wheat and cereal crop breeding.

BACKGROUND OF THE INVENTION

Stripe rust (yellow rust), caused by the pathogen *Puccinia striiformis* f. sp. *tritici* (Pst), is a devastating fungal disease of wheat, causing severe yield losses mainly due to new virulent races that have appeared within the past decades. The use of race-specific resistance genes in wheat varieties has been considered as the most efficient method for disease management. However, the rapid evolution of resistance-breaking pathogen races is emphasizing the need for new sources of broad-spectrum resistance to stripe rust. The genetic bottlenecks associated with plant domestication and subsequent selection in manmade agroecosystems have reduced the genetic diversity of modern crops and increased their vulnerability to biotic and abiotic stresses. One of the ways to address this problem is to recruit the adaptive potential of the wild germplasm. Wild emmer wheat, the tetraploid progenitor of domesticated wheat, distributed along a wide range of habitats in the Fertile Crescent, has valuable unexploited adaptive diversity to various diseases, including stripe rust.

Yr15 is a broad-spectrum stripe rust resistance gene discovered in the 1980s in wild emmer wheat *Triticum turgidum* ssp. *dicoccoides* (DIC hereafter) accession G25 (G25, hereafter). Since its discovery, Yr15 has been introgressed into a variety of worldwide *durum* and bread wheat genetic backgrounds and has provided robust protection against a wide range of Pst isolates from over 34 countries around the world. Previously, Yr15 was mapped to the short arm of chromosome 1B, and for example, a recombinant inbred family segregating for Yr15 was generated by crossing resistant introgression *durum* lines (B9, B10), which carry Yr15 from DIC G25, with the susceptible recurrent line D447. Importantly, Yr15 has been introduced from wild wheat into cultivated *durum* and common wheat to new species only by introgression. The full sequence of the gene was not known, and thus vectors for introduction of the gene do not exist. There is a great need for compositions and methods for conferring Pst resistance to new species. Additionally, resistance genes that can combat the new and more virulent races of Pst are essential.

SUMMARY OF THE INVENTION

The present invention provides isolated DNA of the Wtk1 gene or a functional equivalent capable of conferring resistance to stripe rust, as well as artificial vectors comprising same and proteins encoded by same. Transgenic plants, as well as cells, seeds, and tissue therefrom which express the Wtk1 gene or a functional equivalent thereof are also provided.

According to a first aspect, there is provided an isolated DNA comprising a nucleic acid sequence with at least 80% homology to SEQ ID NO: 1 or a fragment thereof that encodes a protein that confers resistance to Stripe Rust (Pst).

According to another aspect, there is provided an artificial vector comprising the isolated DNA of the invention.

According to another aspect, there is provided a transgenic plant or cell thereof, comprising an isolated DNA of the invention or an artificial vector of the invention.

According to another aspect, there is provided an isolated protein encoded by an isolated DNA of the invention.

According to another aspect, there is provided a method of conferring resistance to Pst to a plant or cell thereof, the method comprising at least one of:

a. expressing in a cell of the plant at least one isolated DNA of the invention or an artificial vector of the invention, and
b. converting at least one wtk1 non-functional allele of a cell of the plant into a functional Wtk1 gene;

thereby conferring resistance to Pst to a plant or cell thereof.

According to another aspect, there is provided a nucleic acid molecule capable of binding differentially to a functional Wtk1 nucleic acid molecule and a non-functional wtk1 nucleic acid molecule, wherein a functional Wtk1 confers resistance to stripe rust (Pst).

According to another aspect, there is provided a method for detecting a functional Wtk1 gene in a sample, wherein a functional Wtk1 confers resistance to stripe rust (Pst), comprising:

a. providing nucleic acids from the sample; and
b. detecting a nucleic acid molecule comprising SEQ ID NO: 1 in the provided nucleic acids, thereby, detecting a functional Wtk1 gene in a sample.

According to another aspect, there is provided a kit comprising at least 2 nucleic acid molecules, wherein the molecules comprise a sequence selected from SEQ ID NO: 69-70 and 103-110.

According to another aspect, there is provided a method of conferring resistance to a pathogen to a plant or a cell, the method comprising expressing in the plant or cell thereof at least protein comprising an amino acid sequence selected from SEQ ID NOs: 124-214.

According to some embodiments, the DNA encodes a protein that confers resistance to Pst. According to some embodiments, the protein that confers resistance comprises the amino acid sequence of SEQ ID NO: 2;

According to some embodiments, the nucleic acid sequence comprises a sequence with at least 80% homology to SEQ ID NO: 6 and a sequence with at least 80% homology to SEQ ID NO: 7. According to some embodiments, the nucleic acid sequence encodes for a first kinase-like domain of Wtk1 (KinI, SEQ ID NO: 4) and a second kinase-like domain of Wtk1 (KinII, SEQ ID NO: 5).

According to some embodiments, the Pst comprises the Warrior race of Pst.

According to some embodiments, the nucleic acid sequence has at least 95% homology to SEQ ID NO: 1. According to some embodiments, the nucleic acid sequence comprises SEQ ID NO: 1. According to some embodiments, the nucleic acid sequence consists of SEQ ID NO: 1.

According to some embodiments, the vector of the invention further comprises at least one nucleic acid sequence with at least 80% homology to a tandem kinase-pseudokinase (TKP)-containing gene. According to some embodiments, the nucleic acid sequence with at least 80% homology to a TKP-containing gene encodes an amino acid sequence selected from SEQ ID NOs: 123-214.

According to some embodiments, the vector of the invention further comprises at least one nucleic acid sequence of a pathogen-resistance gene. According to some embodiments, the pathogen is Pst. According to some embodiments, the pathogen-resistance gene is selected from Yr36, Yr5, Yr18 and Yr46. According to some embodiments, the pathogen-resistance gene is Yr5.

According to some embodiments, the vector of the invention comprises at least one promoter for transcription in plant cells. According to some embodiments, the promoter is the endogenous Wtk1 promoter. According to some embodiments, the at least one promoter is operably linked to the isolated DNA. According to some embodiments, the vector of the invention comprises at least another promoter for transcription in plants operably linked to a TKP-containing gene or a pathogen resistance gene.

According to some embodiments, the sample is from a plant. According to some embodiments, the plant is a cereal plant. According to some embodiments, the cereal plant is any one of barley, rye, triticale, oat, wheat, rice and maize. According to some embodiments, the cereal plant is wheat.

According to some embodiments, the artificial vector of the invention and/or the isolated DNA of the invention is for use in conferring resistance to Pst to a cell of a plant.

According to some embodiments, the isolated protein of the invention comprises an amino acid sequence with at least 80% homology to SEQ ID NO: 2, wherein the isolated protein confers resistance to Pst. According to some embodiments, the isolated protein of the invention consists of the amino acid sequence of SEQ ID NO: 2.

According to some embodiments, the functional Wtk1 nucleic acid molecule is genomic DNA and comprises a nucleic acid sequence comprising SEQ ID NO: 3. According to some embodiments, the functional Wtk1 nucleic acid molecule is cDNA synthesized from mRNA and comprises a nucleic acid sequence comprising SEQ ID NO: 1. According to some embodiments, the non-functional Wtk1 nucleic acid molecule is cDNA synthesized from mRNA and comprises a nucleic acid sequence comprising any one of SEQ ID NOs: 111-117.

According to some embodiments, binding differentially comprises 100% complementarity to the functional Wtk1 nucleic acid molecule or to the non-functional Wtk1 nucleic acid molecule, but not to both.

According to some embodiments, the nucleic acid molecule comprises at least one single nucleotide polymorphism (SNP) that differentiates between a functional Wtk1 nucleic acid molecule and a non-functional wtk1 nucleic acid molecule. According to some embodiments, detecting comprises detecting at least one single nucleotide polymorphism (SNP) that differentiates between SEQ ID NO: 1 and a non-functional wtk1 nucleic acid molecule. According to some embodiments, the SNP is selected from Table 15.

According to some embodiments, the nucleic acid molecule comprises the sequence of any one of SEQ ID NOs: 69-70 and 103-110. According to some embodiments, the nucleic acid molecule consists of the sequence of any one of SEQ ID NO: 69-70 and 103-110.

According to some embodiments, the nucleic acid molecule is a primer. According to some embodiments, the nucleic acid molecule comprises a tag.

According to some embodiments, the detecting comprises:

a. hybridizing at least one nucleic acid molecule of the invention to the provided nucleic acid molecules, wherein the molecule comprises a region with 100% complementarity to SEQ ID NO: 1; and
b. detecting the hybridizing, wherein the presence of the hybridizing indicates the presence of a functional Wtk1 gene in the sample.

According to some embodiments, the at least one nucleic acid molecule comprises a tag and the detecting the hybridizing comprises detecting the tag.

According to some embodiments, the hybridizing comprises at least one of, polymerase chain reaction (PCR), southern blotting and northern blotting.

According to some embodiments, the PCR comprises:

a. amplifying cDNA obtained from the sample with a primer comprising the sequence of SEQ ID NO: 105, a primer comprising the sequence of SEQ ID NO: 106 and a primer comprising the sequence of SEQ ID NO: 107, or with a primer comprising the sequence of SEQ ID NO: 108, a primer comprising the sequence of SEQ ID NO: 109 and a primer comprising the sequence of SEQ ID NO: 110, wherein the primers comprising SEQ ID NO: 105 and SEQ ID NO:108 comprise a first fluorescent tag and the primers comprising SEQ ID NO: 106 and SEQ ID NO: 109 comprise a second fluorescent tag; and
b. detecting a fluorescent product of the amplifying, wherein the presence of the first fluorescent tag indicates the presence of a functional Wtk1 gene in the sample and the presence of the second fluorescent tag indicates the presence of a non-functional wtk1 gene in the sample.

According to some embodiments, the primers are Kompetative Allele Specific PCR (KASP) primers.

According to some embodiments, the method of the invention comprises amplifying the DNA with a primer comprising the sequence of SEQ ID NO: 105, a primer comprising the sequence of SEQ ID NO: 106, a primer comprising the sequence of SEQ ID NO: 107, a primer comprising the sequence of SEQ ID NO: 108, a primer comprising the sequence of SEQ ID NO: 109, and a primer comprising the sequence of SEQ ID NO: 110.

According to some embodiments, the kit of the invention comprises a molecule comprising the sequence of SEQ ID NO: 105, a molecule comprising the sequence of SEQ ID NO: 107, and optionally a molecule comprising the sequence of SEQ ID NO: 106. According to some embodiments, the kit of the invention comprises the sequence of SEQ ID NO: 108, a molecule comprising the sequence of SEQ ID NO: 110, and optionally a molecule comprising the sequence of SEQ ID NO: 109.

According to some embodiments, at least one of the molecules comprises a tag.

Further embodiments and the full scope of applicability of the present invention will become apparent from the detailed description given hereinafter. However, it should be understood that the detailed description and specific examples, while indicating preferred embodiments of the invention, are given by way of illustration only, since various changes and modifications within the spirit and scope of the invention will become apparent to those skilled in the art from this detailed description.

BRIEF DESCRIPTION OF THE DRAWINGS

Some embodiments of the invention are herein described, by way of example only, with reference to the accompanying drawings. With specific reference now to the drawings in detail, it is stressed that the particulars shown are by way of example and for purposes of illustrative discussion of embodiments of the invention. In this regard, the description together with the drawings makes apparent to those skilled in the art how embodiments of the invention may be practiced.

In the drawings:

FIG. 1: Collinearity of the wheat genetic and physical maps of the Yr15 region on chromosome arm 1BS with *Brachypodium*, *Oryza*, and *Sorghum*. A diagram showing the genetic map of 1BS (Td1BS, far left) based on the B9×D447 mapping population (*T. durum* x *T. dicoccoides*; scale in cM). The anchored CS 1BS (*T. aestivum*) scaffolds are shown as rectangles, with the rectangle length corresponding to the estimated length of CS 1BS pseudomolecule (from 25 Mb to 233 Mb). Three vertical lines (on the right) correspond to *B. distachyon* chromosome 2 (Bd2; from 37.5 Mb to 38.8 Mb), *O. sativa* chromosome 5 (Os5; from 0.7 Mb to 2.0 Mb), *S. bicolor* chromosome 9 (Sb9; from 1.3 Mb to 2.8 Mb). Each dash line starting in the tetraploid wheat genetic map and ending in CS wheat scaffold represents a marker locus assigned to the genetic map for which a co-linear gene was identified on the wheat scaffold. The homologous relationships between Ta1BS, Bd2, Os5, and Sb9 are also shown by gray lines.

Figure 2:
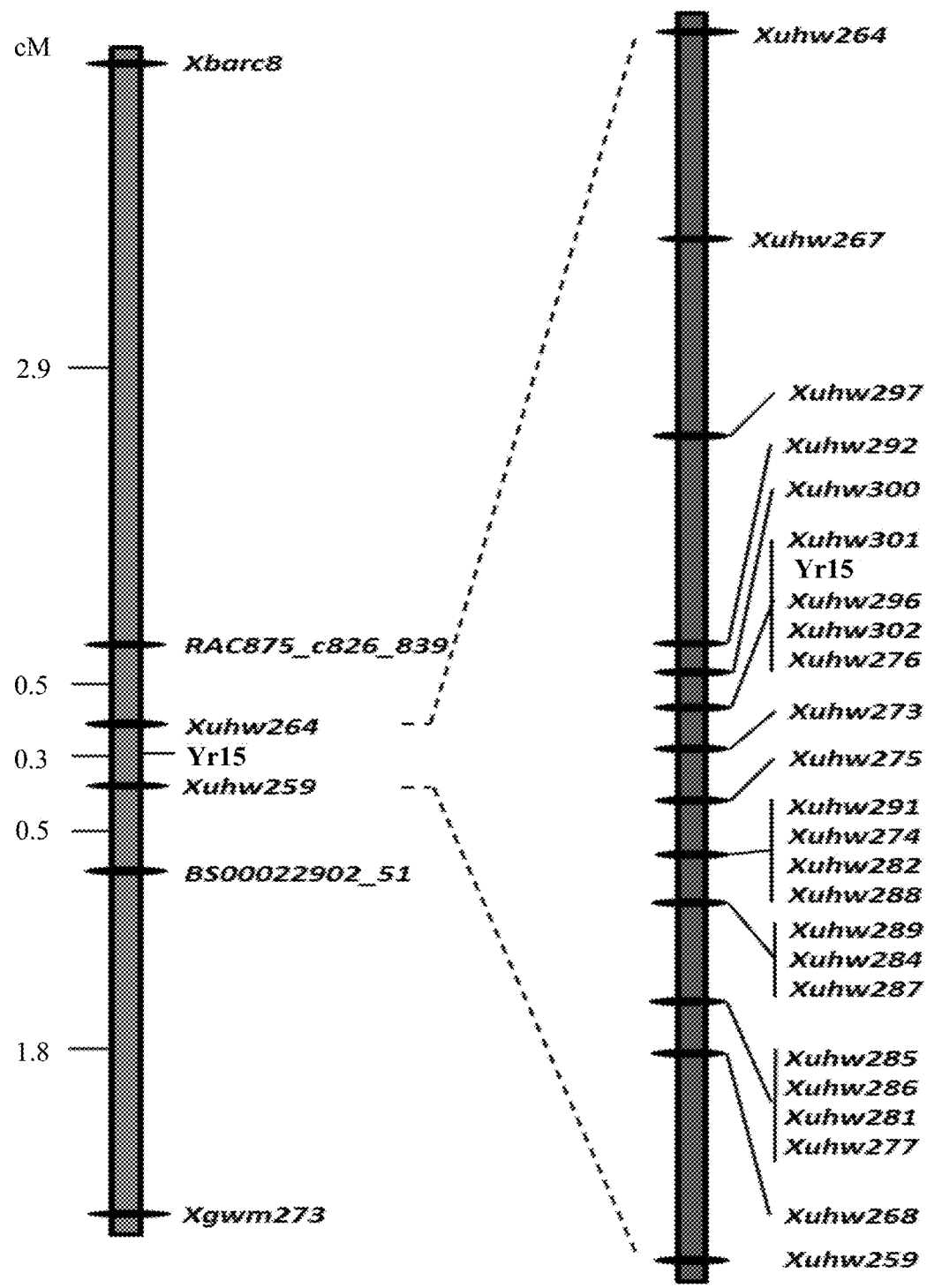
Figure 2:
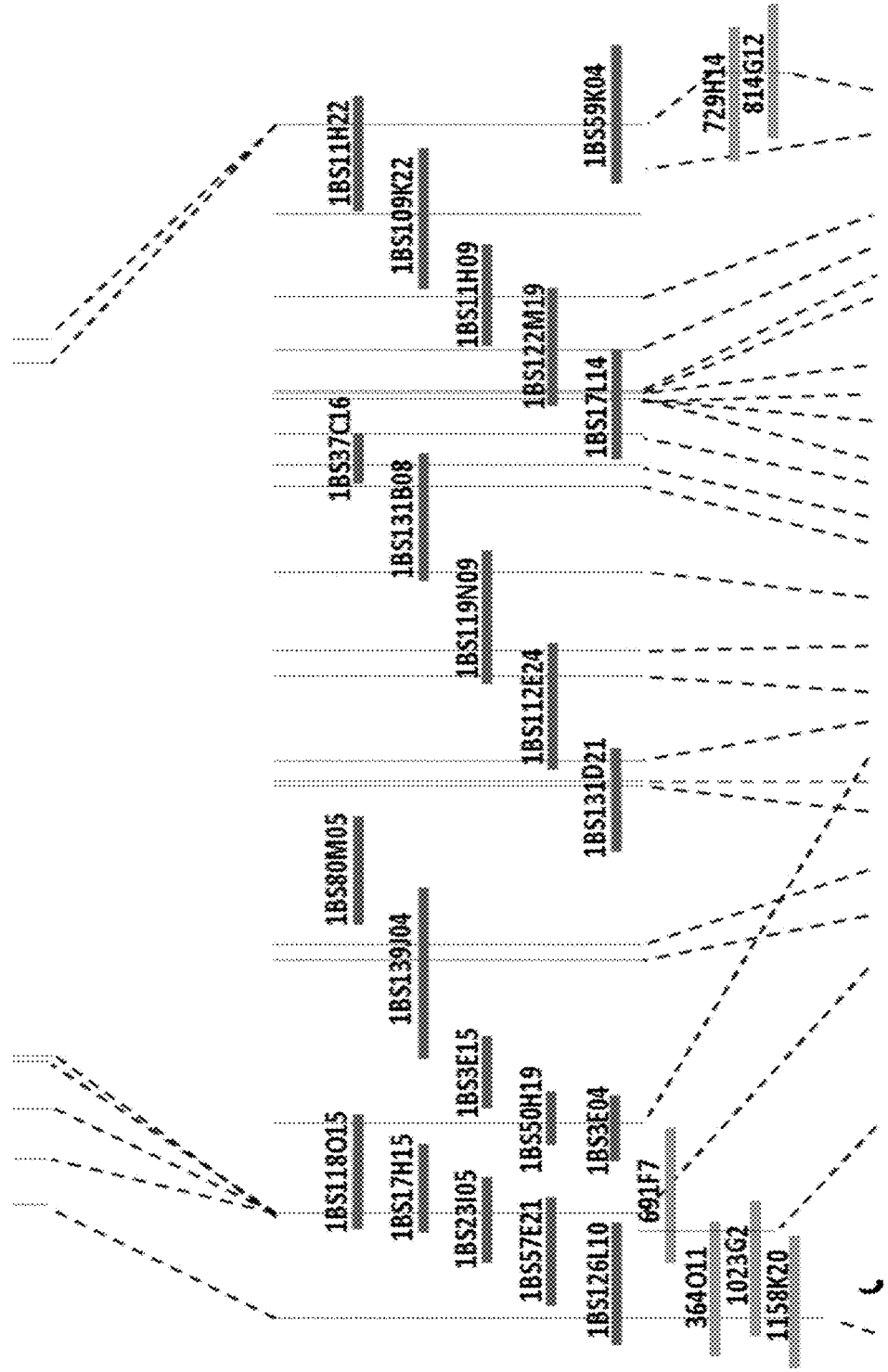
Figure 2:
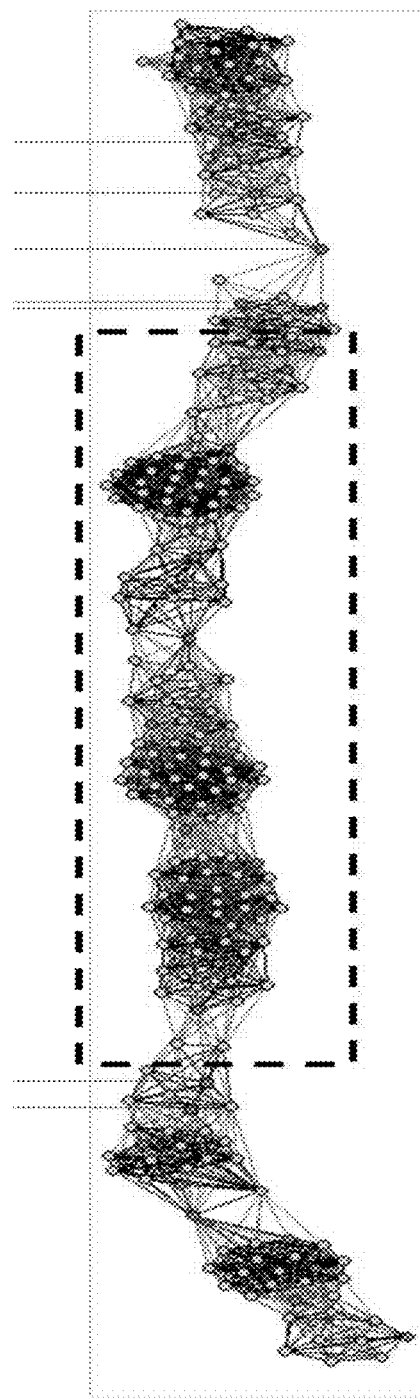

FIG. 2: Anchoring of CS 1BS scaffold to the high-resolution genetic map of Yr15 region on chromosome arm 1BS. The left panel shows a genetic map of the Yr15 region based, which is based on a mapping population of 302 $F_2$ plants derived from a D447×B9 or D447×B10 cross. The names of markers appear on the right side of the map and the relative genetic distances in cM are on the left. Detailed description of the markers is presented in Tables 2 and 3. The second panel shows a high-resolution genetic map of the Yr15 region based on 8573 $F_2$ plants, presents a 0.3 cM interval with the relative positions of the closest to Yr15 CAPS markers. The third panel shows the order of six CS BAC clones and 21 CS 1BS BAC clones that span the region corresponding to Yr15 in DIC, as anchored by uhw264 and uhw259. The full names of the BAC clones contain the prefix "TaaCsp" (e.g., TaaCsp1BS126L10 for 1BS126L10). The last panel shows a part of the CS 1BS physical scaffold, ctg49, which harbors the region corresponding to the Yr15 region, is presented as a network of clones (nodes) and clone overlaps (edges) that was assembled by LTC software.

Figure 3:
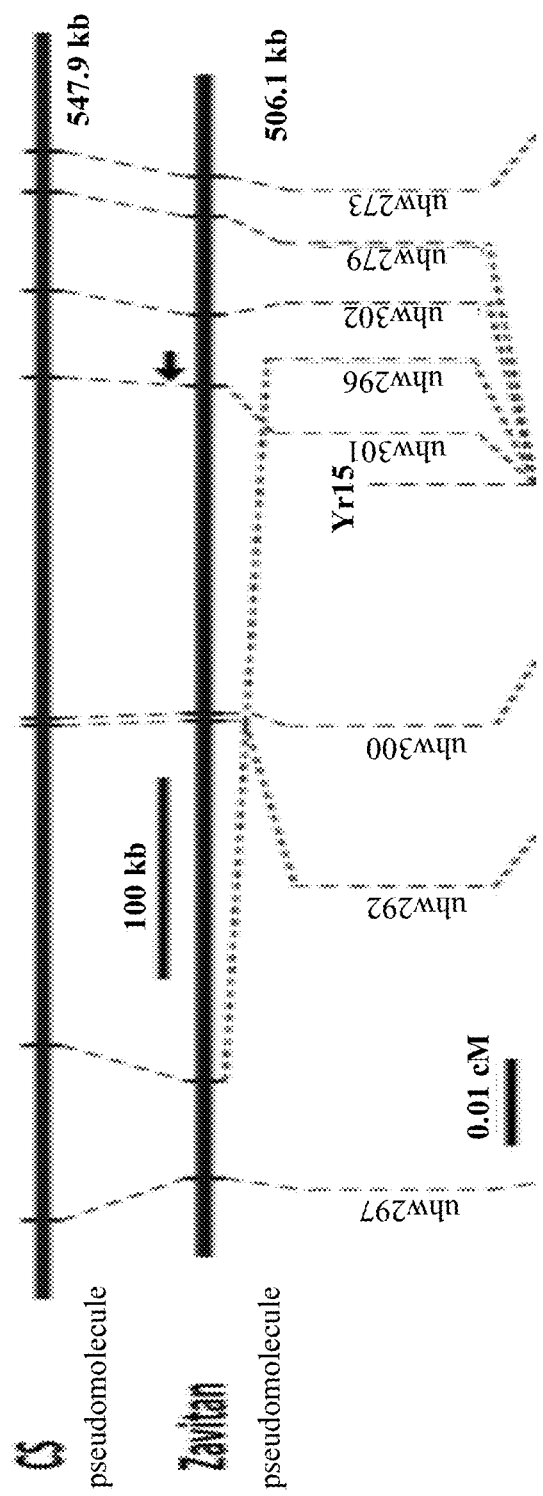
Figure 3:
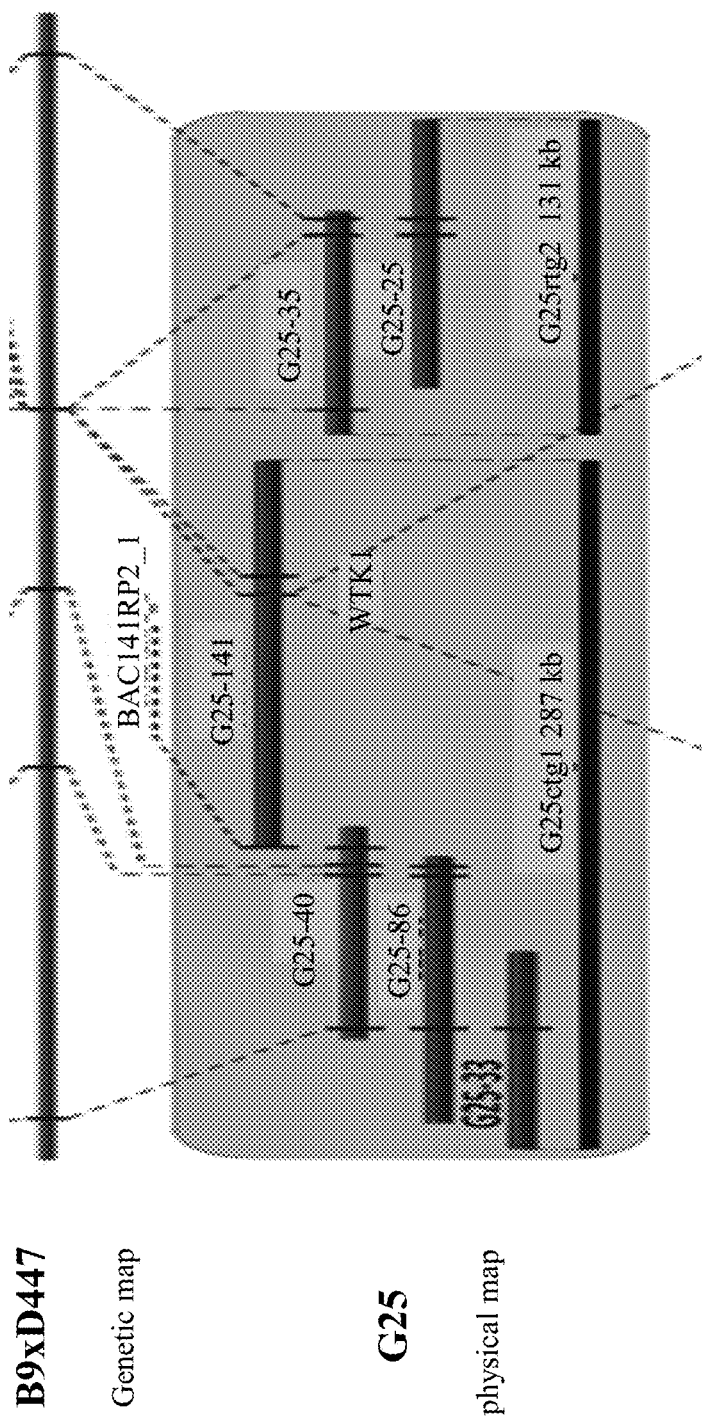
Figure 3:
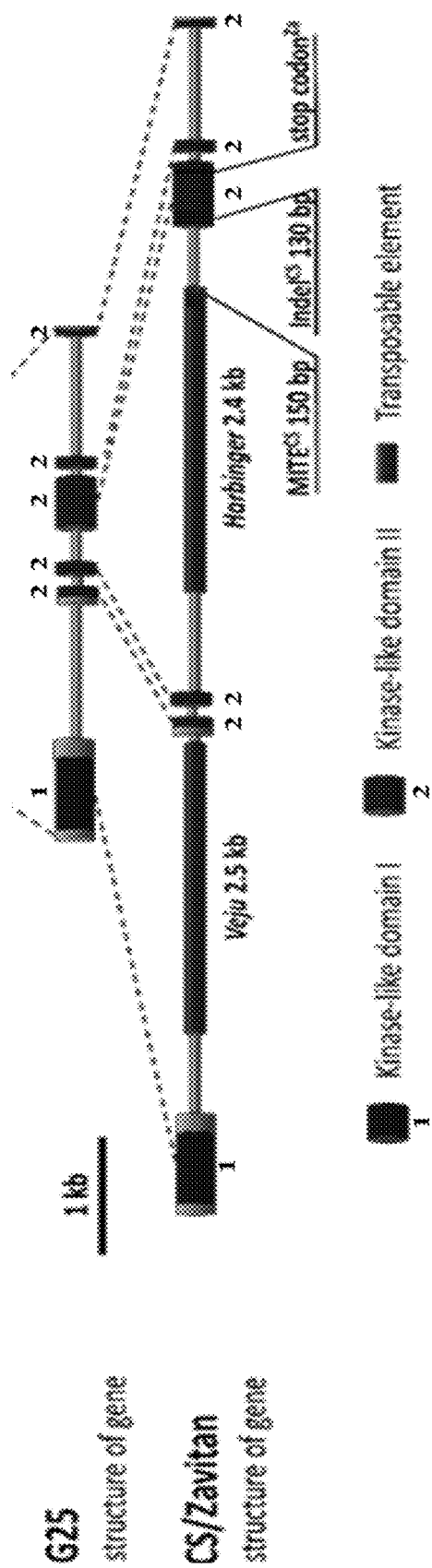

FIG. 3: Map-based cloning of Yr15. The upper and second rows show the genomic sequence of CS (upper) and Zavitan (second) 1BS pseudomolecules harboring the WTK1 region. The third row shows a genetic map of the 1BS region carrying Yr15. Marker Xuhw301 was developed based on the WTK1 sequence. The fourth row shows a G25 BAC-based physical map covering the Yr15 region. Assembly of BAC sequences yielded contigs G25ctg1 (287 kb) and G25ctg2 (131 kb). Marker BAC141RP2_1 was used to connect G25-141 and G25-40 BAC clones. The fifth and the last rows show the structure of Wtk1 alleles from G25 (fifth) and CS, Zavitan (last). Kinase-like domain I (KinI), kinase-like domain II (KinII) and transposable elements are denoted by 1, 2, and 3, respectively. Features that are unique to CS are marked with CS, while those that are present only in Zavitan are marked with ZA.

Figure 4A:
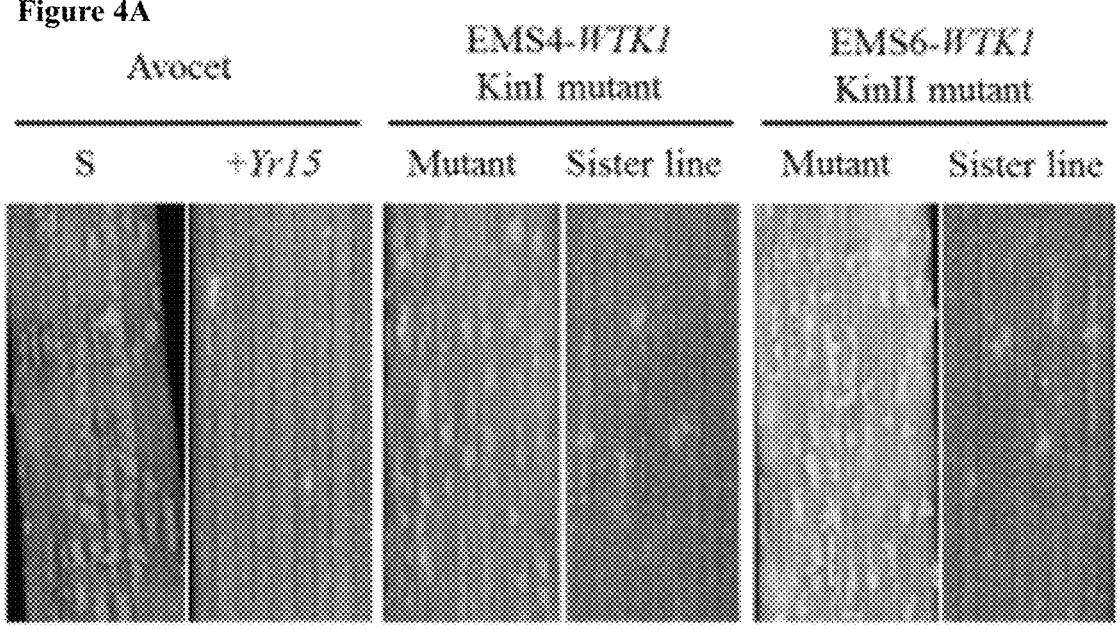

FIG. 4A: Micrographs showing loss of resistance to Pst in Wtk1 kinase-like domain mutants. EMS4 and EMS6 carry mutations in KinI and KinII, respectively (Table 7). Avocet+Yr15, Avocet S, and sister lines of EMS4 and EMS6 that carry wild type Wtk1 were used as controls.

Figure 4B:
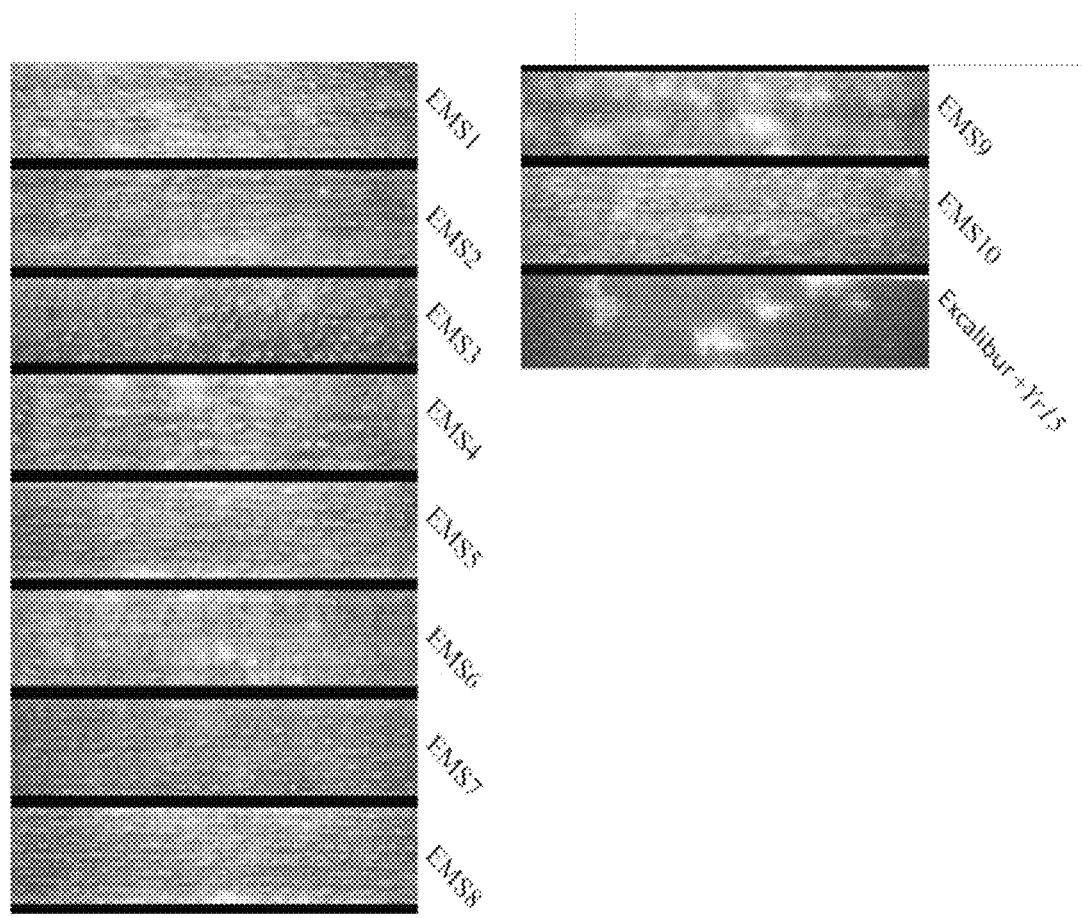

FIG. 4B: Effect of Wtk1 mutations on resistance to Pst. Micrographs showing loss of Pst resistance associated with mutations to the Wtk1 kinase-like domains. The mutagenized lines EMS1 to EMS5 carry independent mutations in kinase-like domain I, while EMS6 to EMS10 carry independent mutations in KinII. The 10 independent mutations are described in detail in Table 7. The responses of these mutagenized lines to infection with Pst were compared to those of their wild type resistant parental lines, such as the Excalibur+Yr15 introgression line, which carry a functional Wtk1 copy of the gene. Plants were inoculated with Pst isolate #5006 at the four-leaf stage. The wtk1-mutagenized lines showed completely susceptible responses to Pst, whereas the Excalibur+Yr15 plants that harbor the functional Wtk1 allele were highly resistant and showed a typical HR.

Figure 4C:
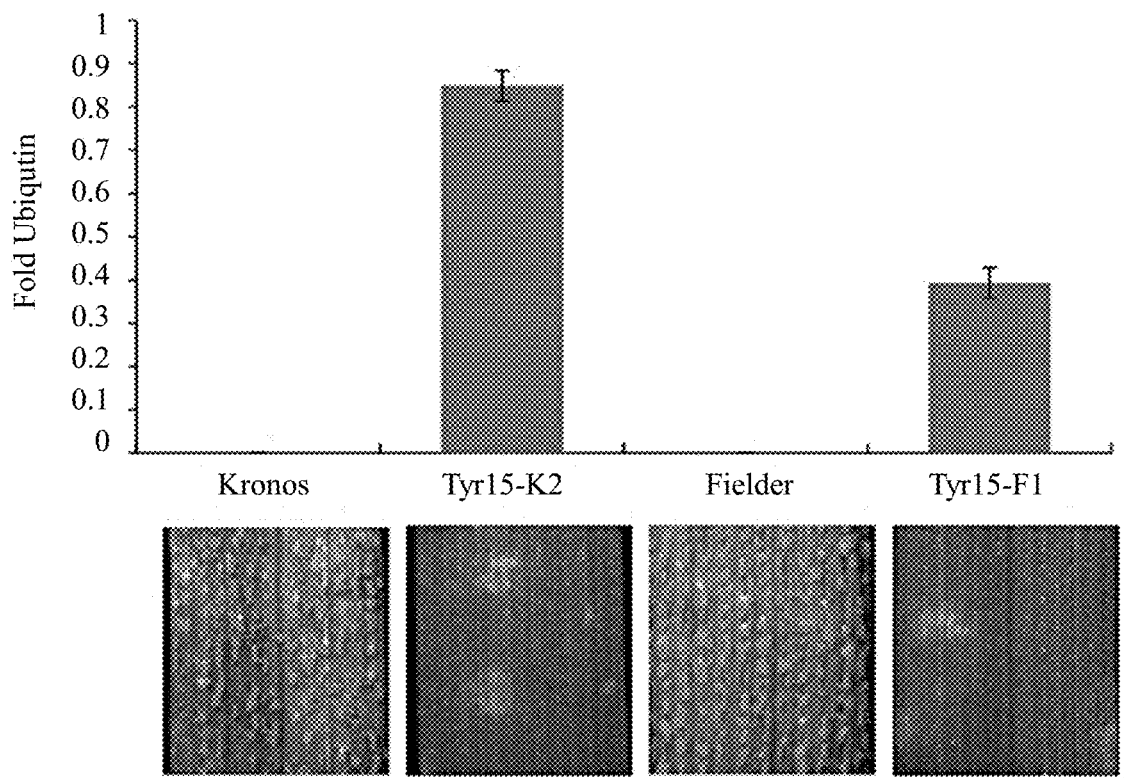

FIG. 4C: Bar graphs and micrographs showing Wtk1 transcript levels and the resistance phenotype, respectively, in transgenic wheat. Upper panel: Wtk1 transcript levels in independent transgenic events Tyr15-K2 and Tyr15-F1 were determined by quantitative reverse transcription polymerase chain reaction (qRT-PCR). The non-transformed wheat varieties Kronos and Fielder served as negative control. Lower panel: Phenotypic response to infection with Pst.

Figure 4D:
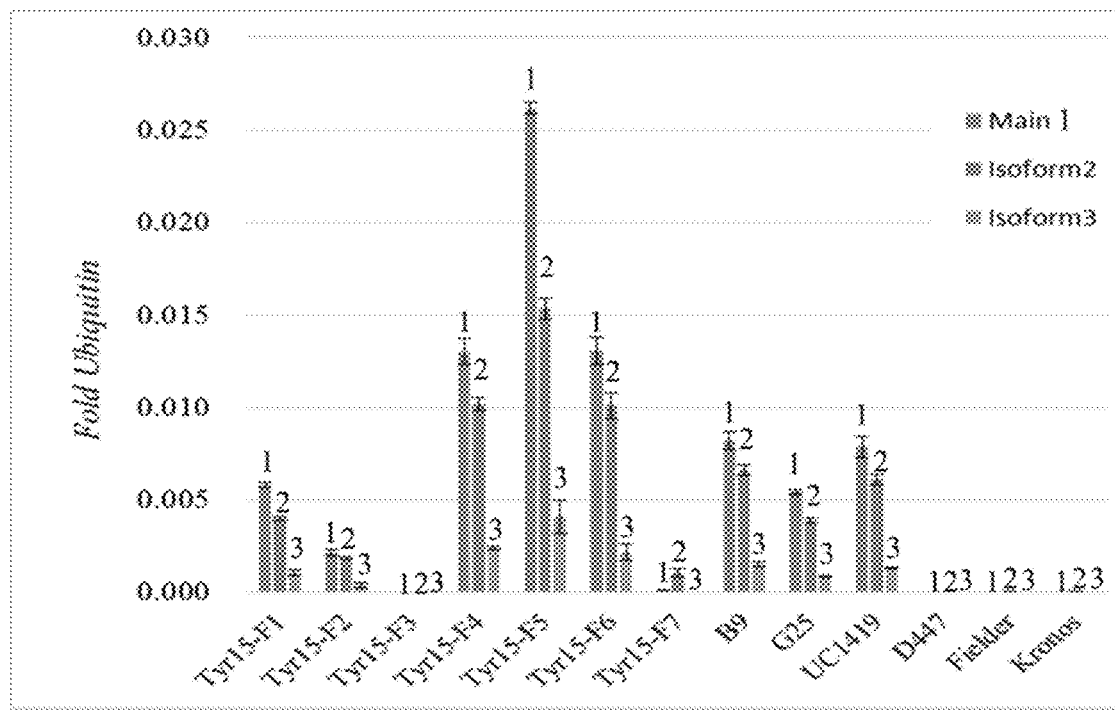
Figure 4E:
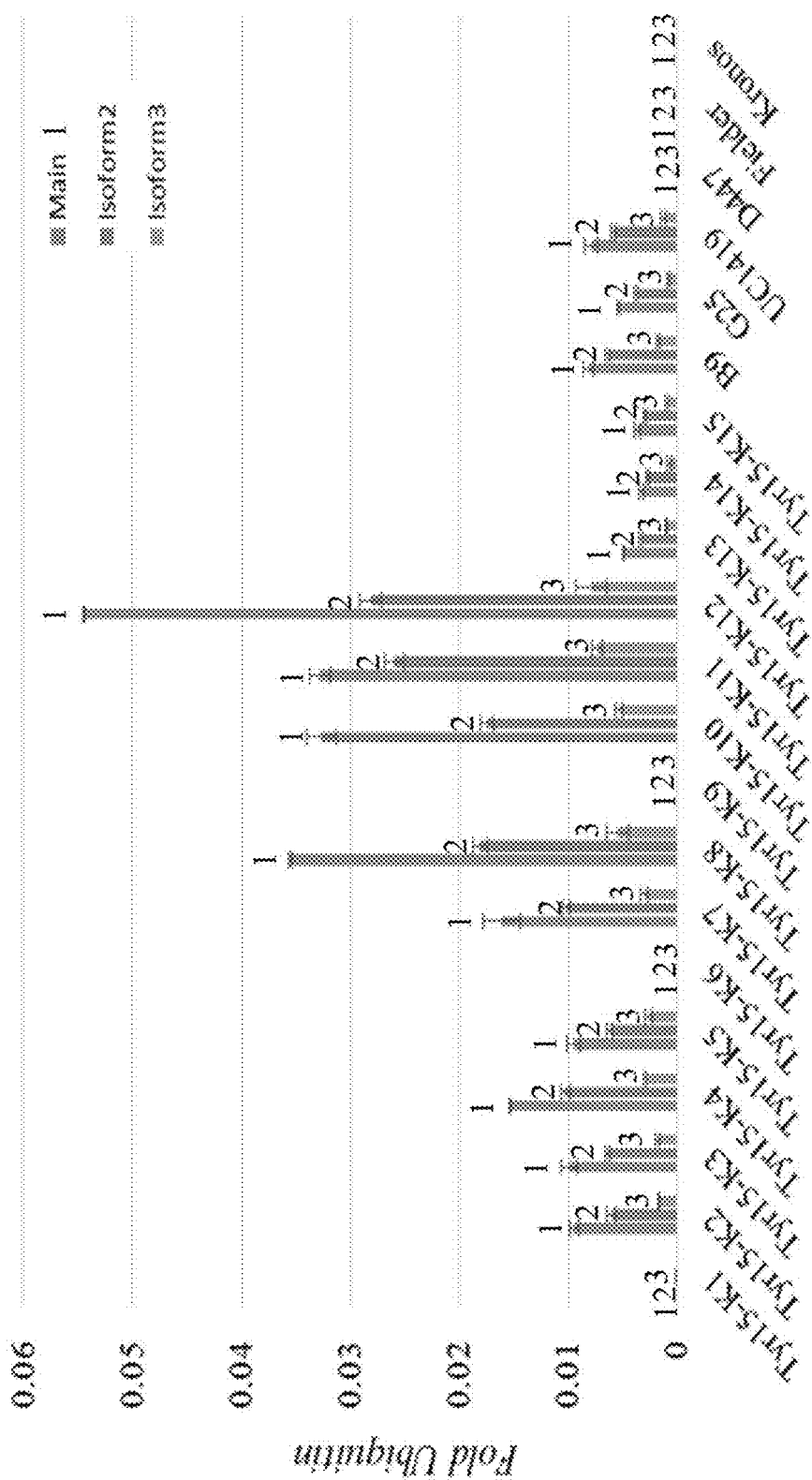

FIGS. 4D-4E: Transcript levels of the three isoforms of Wtk1 in $T_0$ transgenic plants. Bar graphs of (4D) seven independent Wtk1 transgenic events in the Fielder background (Tyr15-F1~F7). Tyr15-F3 and Tyr15-F7 did not show expression of Wtk1. Bar graphs of (4E) Fifteen independent Yr15 transgenic events in the Kronos background (Tyr15-K1~K15). Tyr15-K1, K6, and K9 did not show expression of Wtk1. The Yr15 introgression lines B9 and UC1419, and the donor line G25 served as positive controls, while D447, Fielder and Kronos, which contain non-functional wtk1 alleles served as negative controls. Values are in fold-Ubiquitin levels calculated with the delta CT method.

Figure 4F:
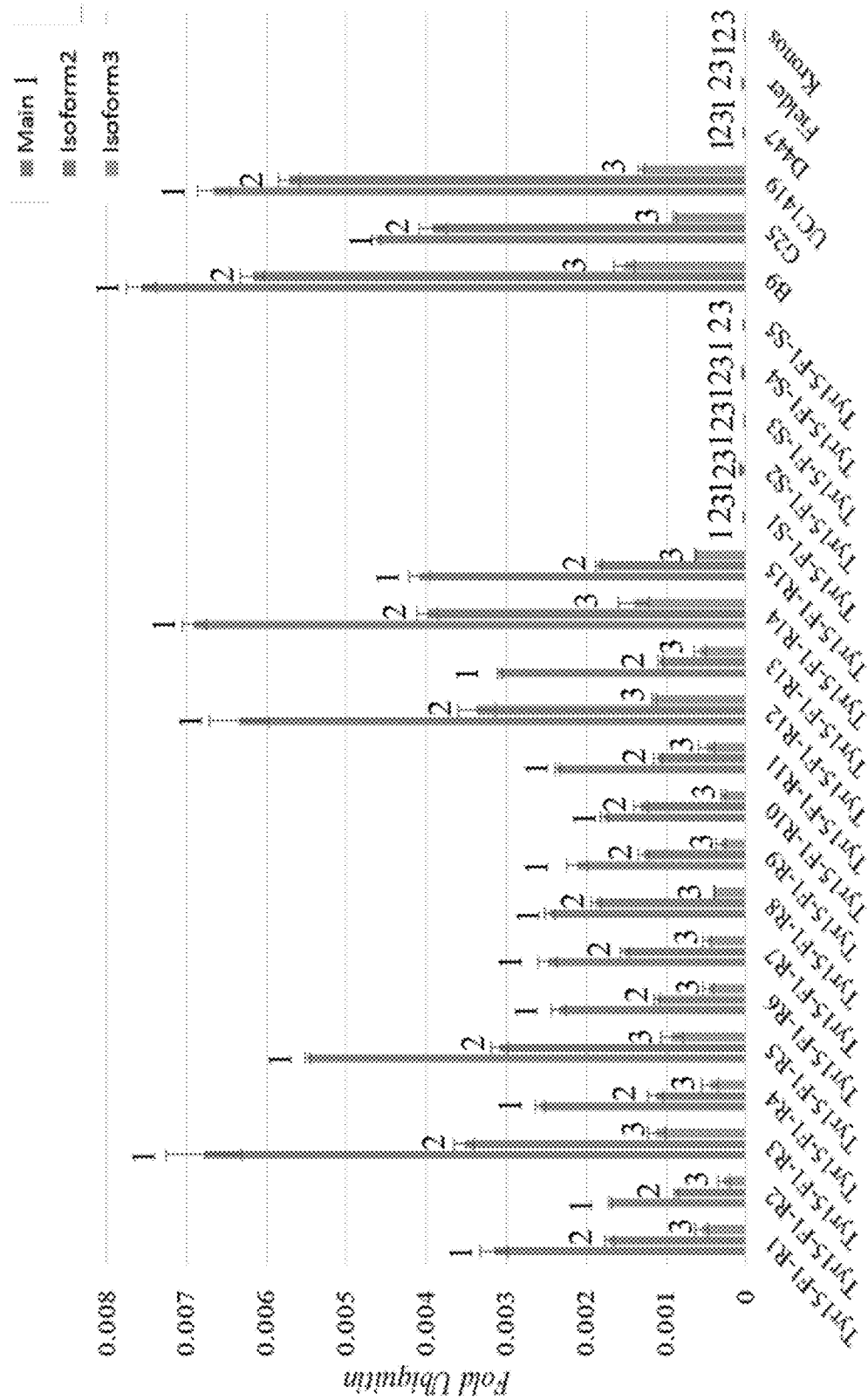

FIG. 4F: Transcript levels of Wtk1 in $T_1$ plants of transgenic family Tyr15-F1. Bar graph of fifteen resistant (R1-15) and five susceptible (S1-5) $T_1$ sister lines were tested for Wtk1 transcript levels after inoculation with race PST-130. The Yr15 introgression lines (B9, UC1419) and donor line (G25) were served as positive controls, whereas tetraploid wheat D447, non-transgenic Fielder and Kronos served as negative controls. Values are in fold-Ubiquitin levels calculated with the delta CT method.

Figure 4G:
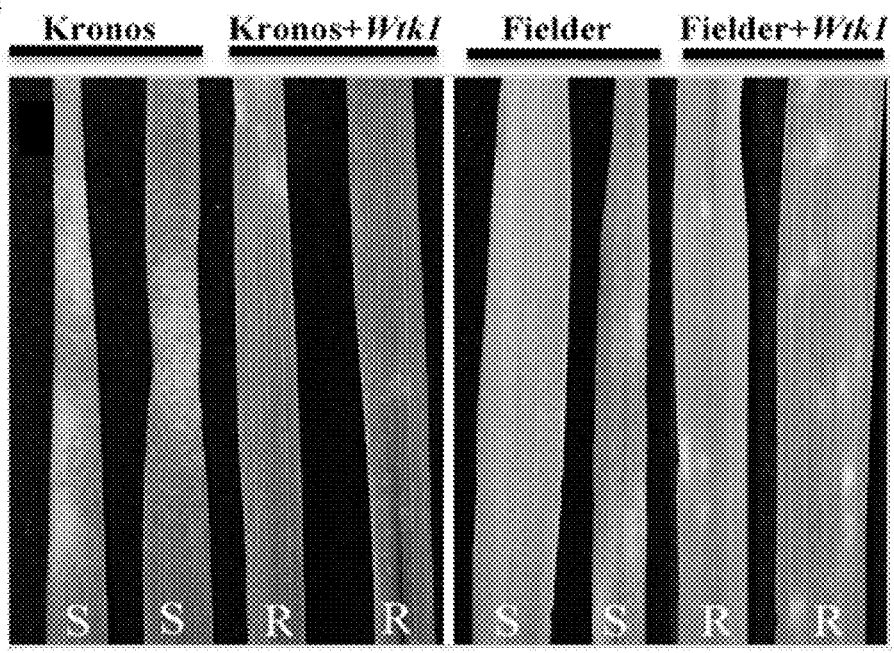
Figure 4H:
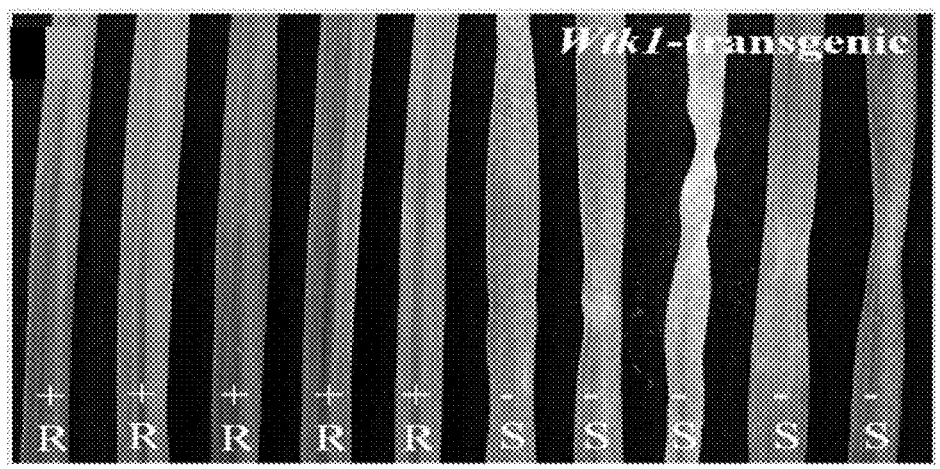
Figure 4I:
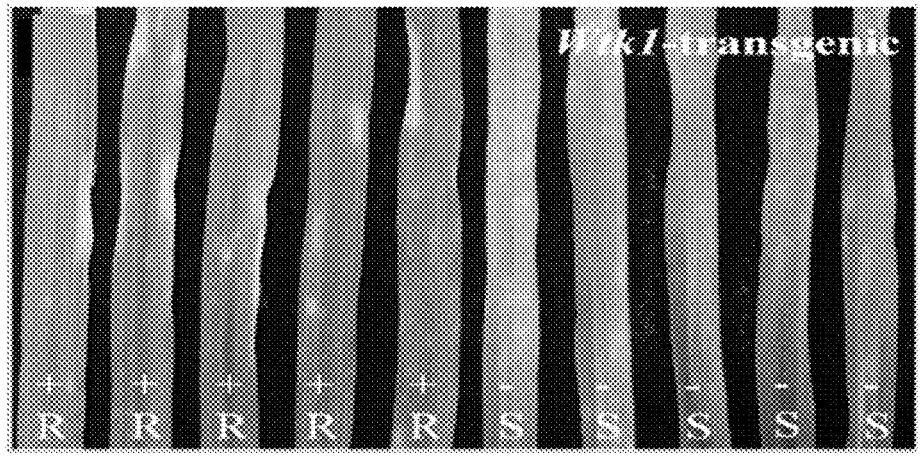

FIGS. 4G-4I: Co-segregation of the Wtk1 transgene with resistance to stripe rust in the $T_1$-generation. Micrographs showing (4G) resistance response of *durum* wheat and common wheat $T_1$ plants expressing the Wtk1 transgene after inoculation with Pst race PST-130. Kronos+Wtk1 plants represent the *durum* wheat (tetraploid) transgenic family Tyr15-K12, while Fielder+Wtk1 plants represent the common wheat (hexaploid) transgenic family Tyr15-F1. Non-transgenic control plants Kronos and Fielder, which are susceptible to PST-130, served as negative controls. Also, micrographs showing (4H-4I) Co-segregation of the Wtk1 transgene with resistance response on $T_1$ seedlings from events Tyr15-K8 (4H) and Tyr15-F1 (4I). Plants from Tyr15-K8 and Tyr15-F1 carrying Wtk1 (+) showed a typical Yr15-mediated stripe rust resistance (R), while progenies without Wtk1 (−), carrying only wtk1 were susceptible (S).

Figure 4J:
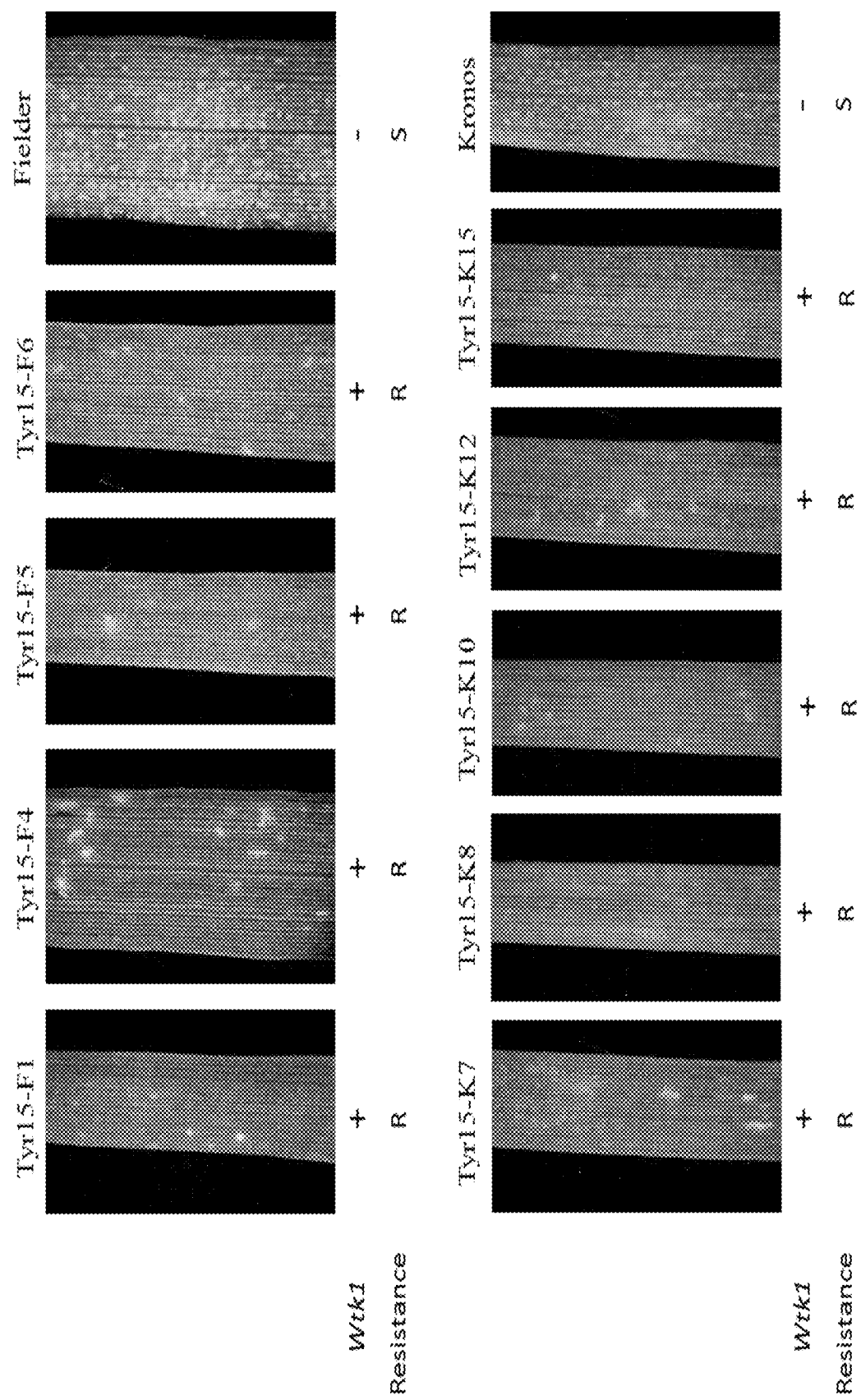

FIG. 4J: Resistance phenotype in $T_2$ Wtk1 transgenic lines inoculated with Pst isolate #5006. Micrographs showing the non-transgenic Fielder and Kronos serving as negative controls. Leaf phenotype: R, resistant; S, susceptible.

Figure 5:
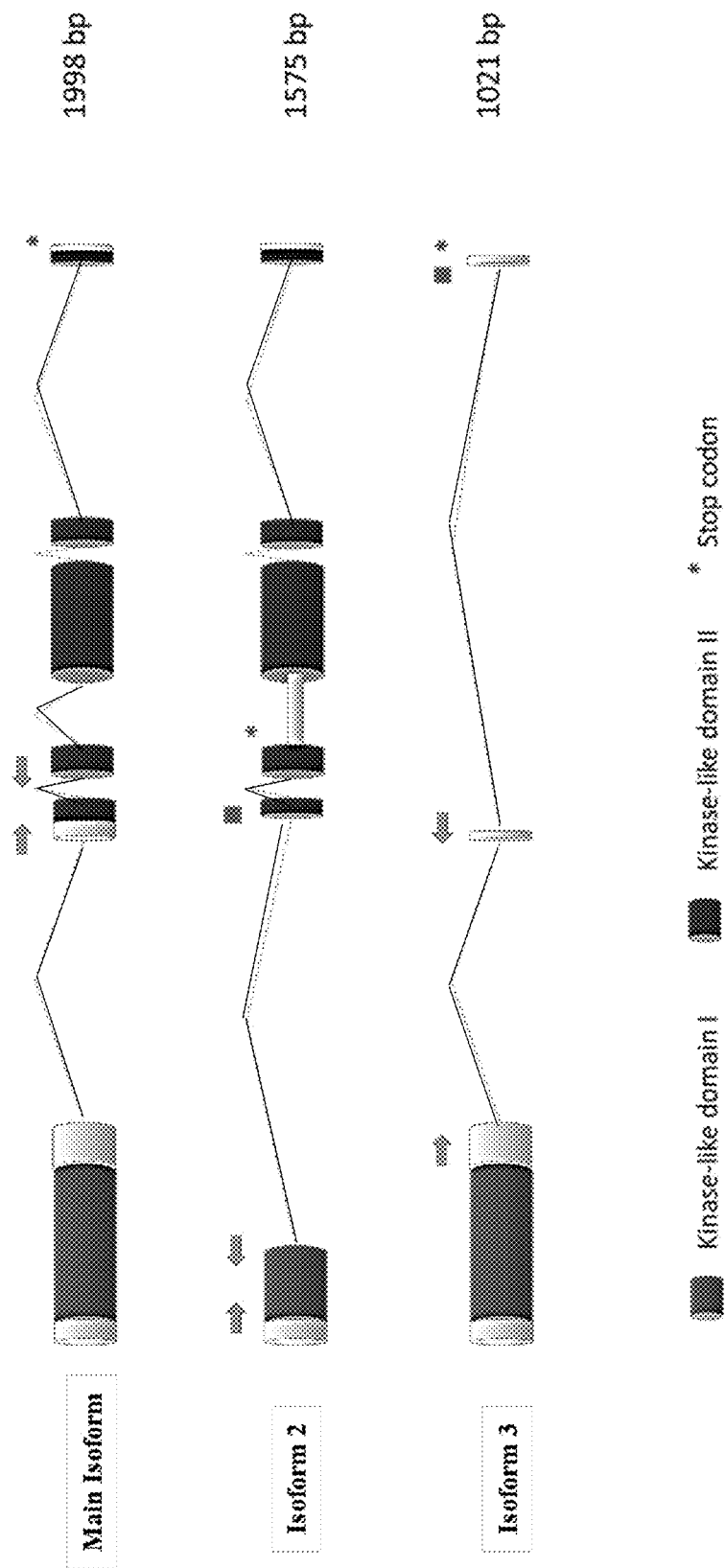

FIG. 5: WTK1 alternative splice forms. Protein diagram showing the Main isoform (representing 85.7% of the sequenced WTK1 transcripts) encodes the complete Wtk1 protein. Isoform2 (9.5%) results from premature splicing site at a 5' donor in exon 1 (532 bp before the conserved GT splice site) and an alternative 3' splice acceptor site on exon 2 as well as retention of intron 3. These differences in splicing generate a premature stop codon in intron 3. Isoform3 (4.8%) derives from use of both a 3' alternative acceptor site in exon 2 (165 bp before the conserved GT splice site), and a 3' alternative acceptor site in exon 6 (80 bp after the conserved AG splice site). Color codes are as follows: KinI in light grey, KinII in dark grey and non-conserved protein parts in white. A star indicates a stop codon. The arrows indicate the location of the isoform-specific primers that were used for expression analysis of the different splice forms.

Figure 6A:
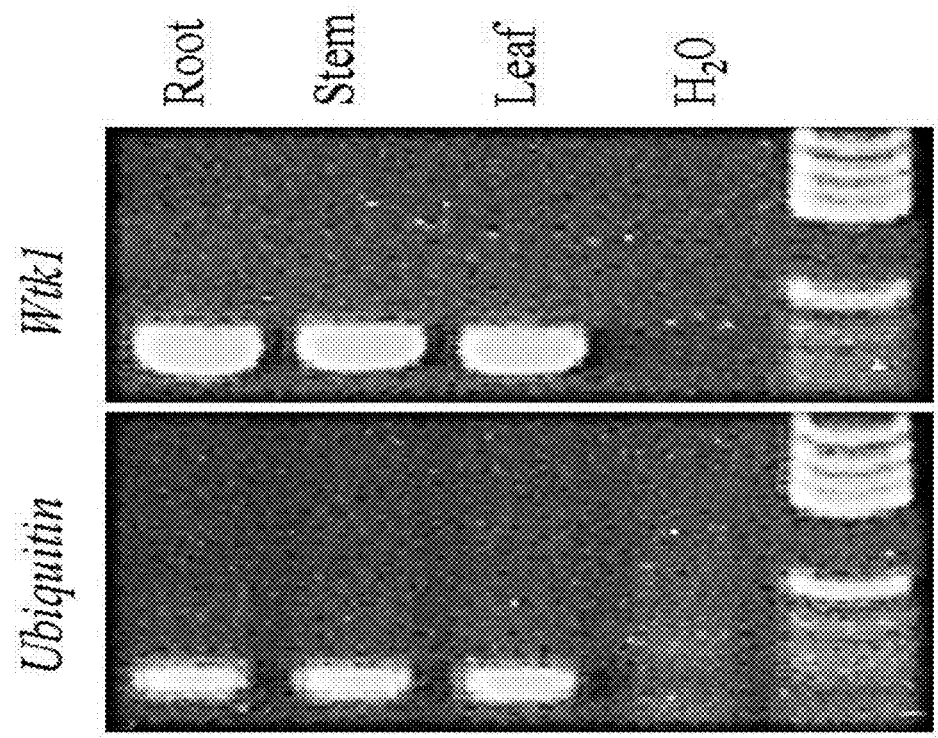

FIG. 6A: Gel photograph of a Wtk1 expression survey in root, stem, and leaf tissue of B9 by RT-PCR using Ubiquitin as an endogenous control.

Figure 6B:
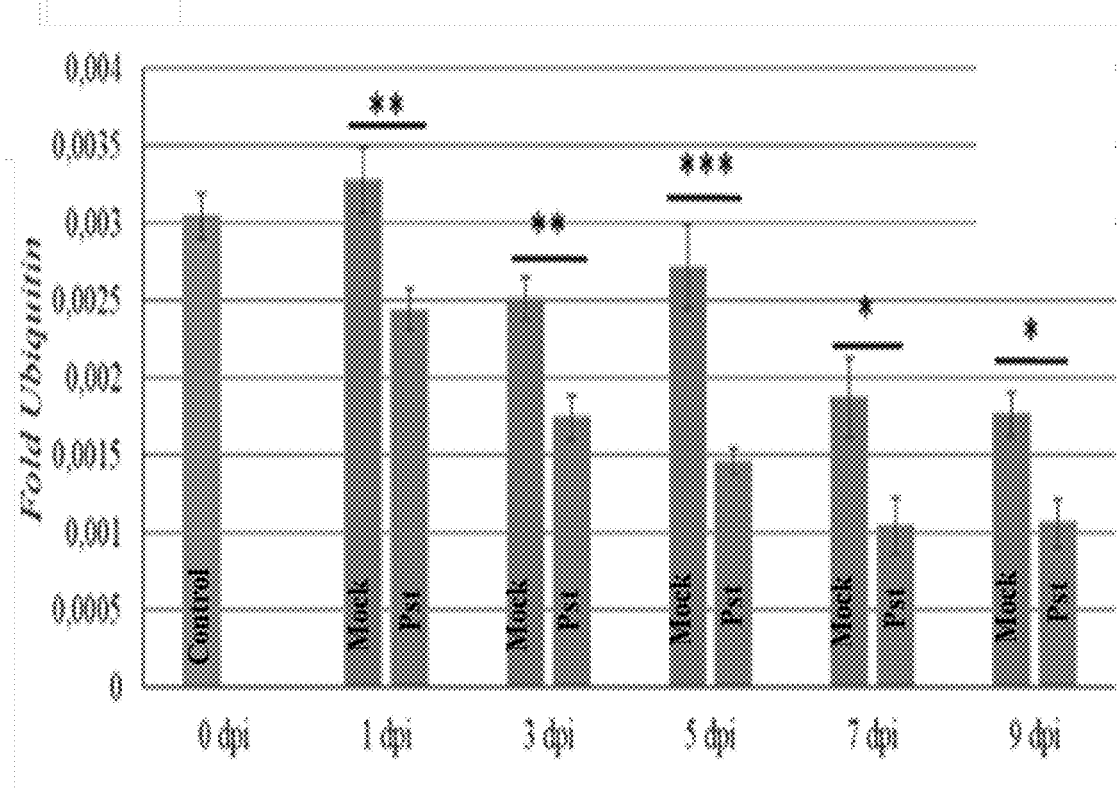

FIG. 6B: Bar graphs of transcript levels of the Wtk1 Main isoform in mock- or Pst-inoculated B9 plants. Error bars denote SEM based on six biological and three technical replicates. Asterisks indicate the level of significance by t-test: $P<0.05$ (*), $P<0.01$ (), $P<0.001$ (*).

Figure 6C:
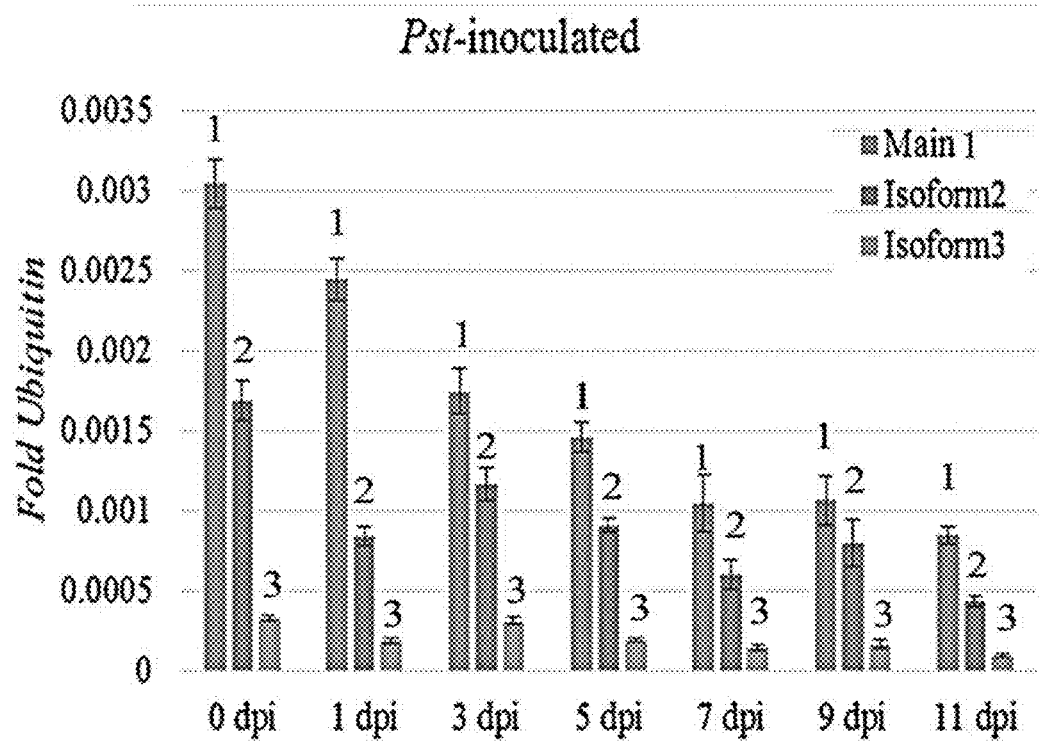
Figure 6D:
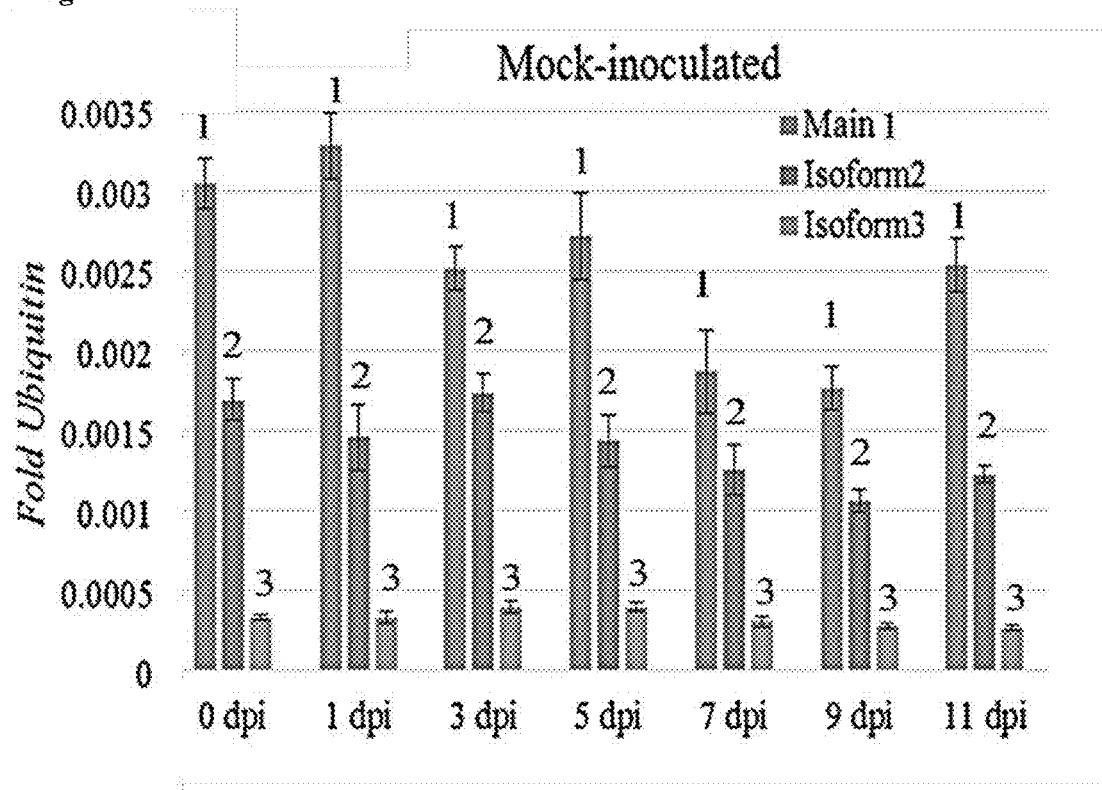

FIGS. 6C-6D: Bar graphs of transcript levels of the Wtk1 Main isoform, Isoform2, and Isoform3 (See FIG. 11) in Pst- (6C) or mock- (6D) inoculated B9 plants. Error bars denote SEM based on six biological and three technical replicates.

Figure 7:
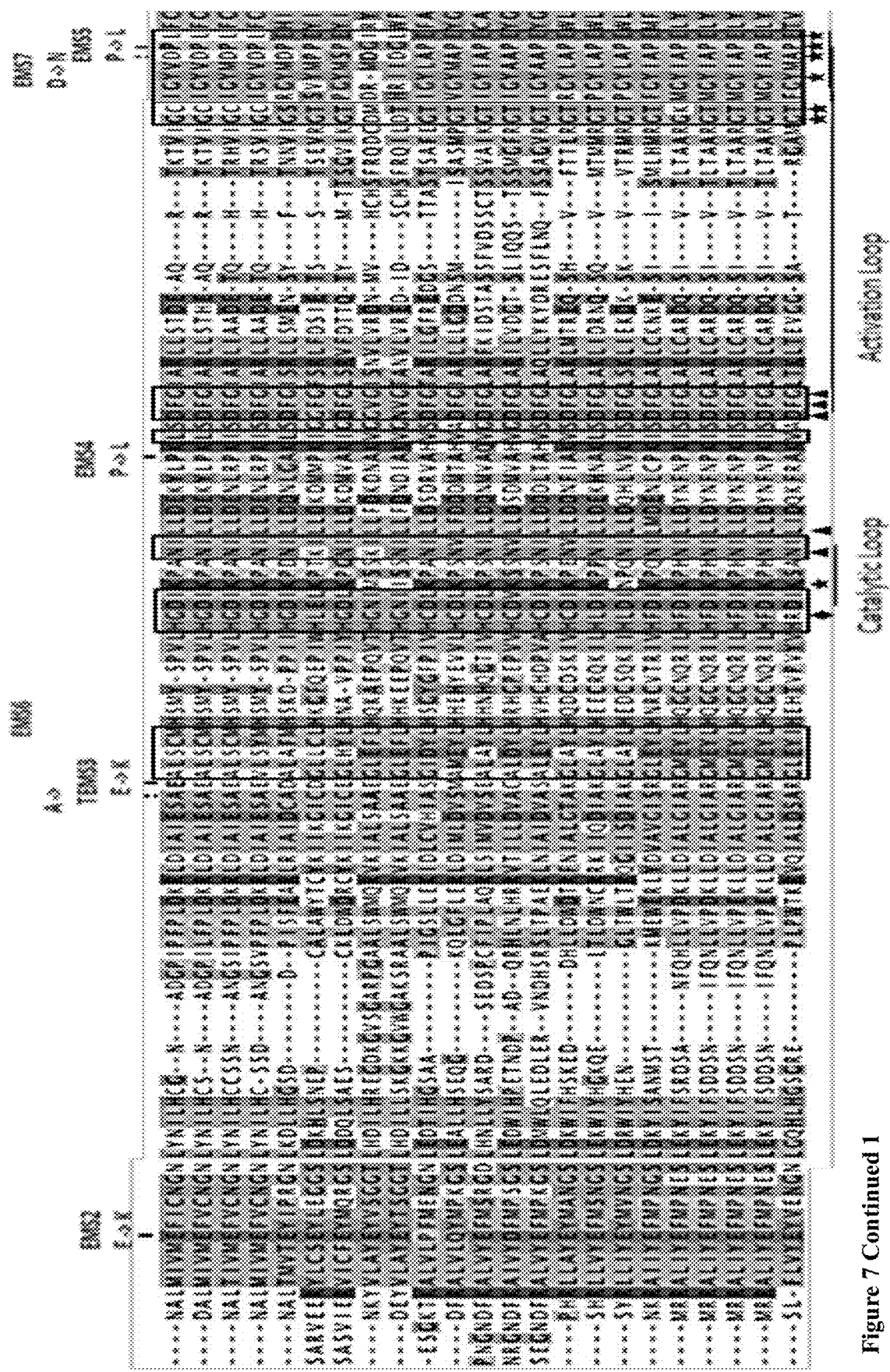
Figure 8A:
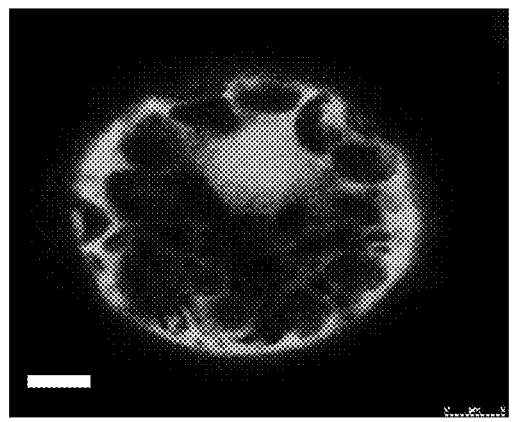
Figure 8B:
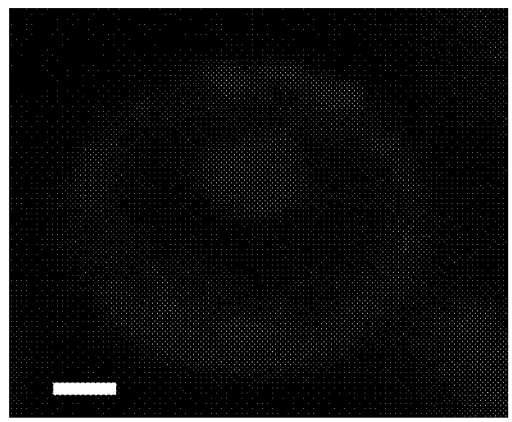
Figure 8C:
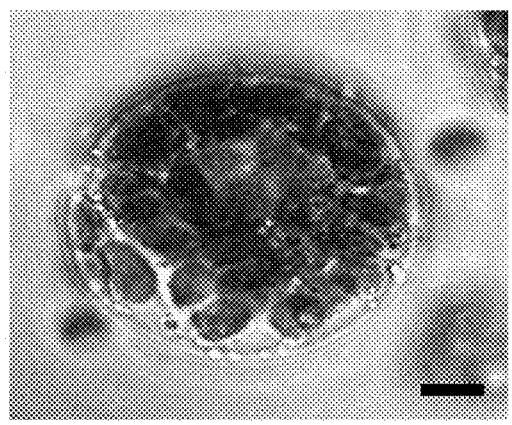
Figure 8D:
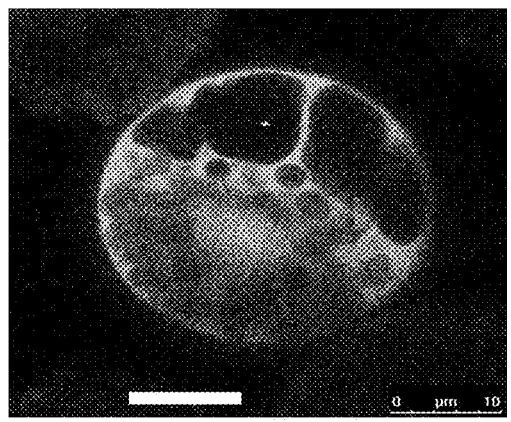
Figure 8E:
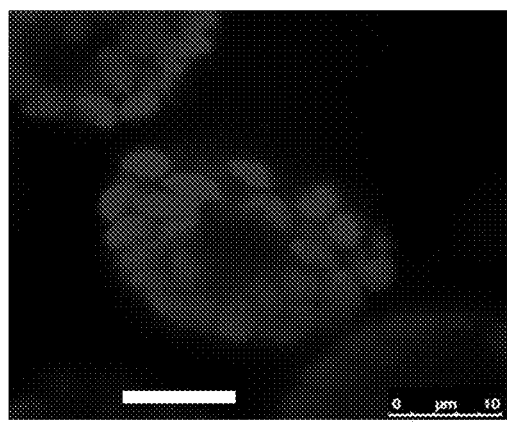
Figure 8F:
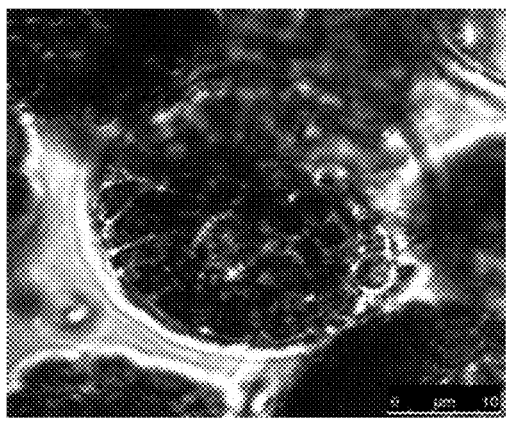
Figure 8G:
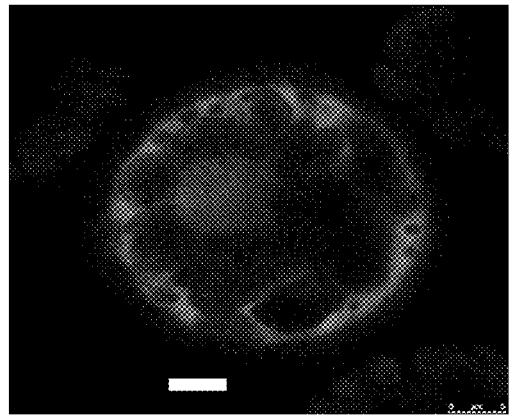
Figure 8H:
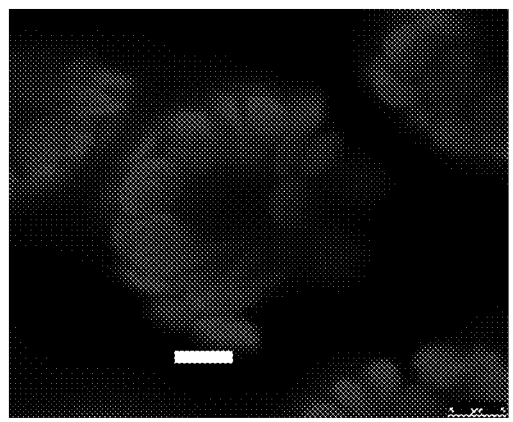
Figure 8I:
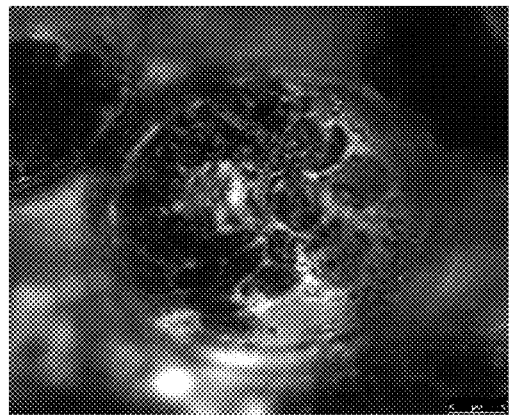

FIG. 7: WTK1 protein structure. A multiple alignment of WTK1 with 23 kinase domains from RPG1, MLOC_38442, WKS1, WAK5, PTO and various plant pattern recognition receptors (PRRs) was carried out with the Clustal Omega software. Amino acid residues that form the ATP and substrate binding sites are labeled by black triangles or black stars, respectively. Residues that form a part of the catalytic loop or activation loop are underlined. The red diamond corresponds to the conserved arginine (R) residue within the catalytic loop that classifies kinases to either RD or non-RD groups. Amino acids affected by EMS mutagenesis resulting in WTK1 loss of function are indicated by bold red letters. EMS mutagenized line designation and amino acid changes in that line are indicated above the sequence of WTK1 KinI or KinII.

FIGS. 8A-8I: Subcellular localization of WTK1 revealed by transient expression in barley protoplasts. Micrographs of fusions of GFP to the C-termini of (8A) KinI, amino acids 1-326, (8D) the KinII, amino acids 346-665, and (8G) the entire WTK1 open reading frame. (8B) DAPI and (8E, 8H) chloroplast auto-fluorescence of the cells in their respective rows. (8C, 8F, 8I) bright-field visualization of the cells in their rows. Scale bar is 5 μm except in (8D), (8E), and (8F), where it is 10 μm.

Figure 9:
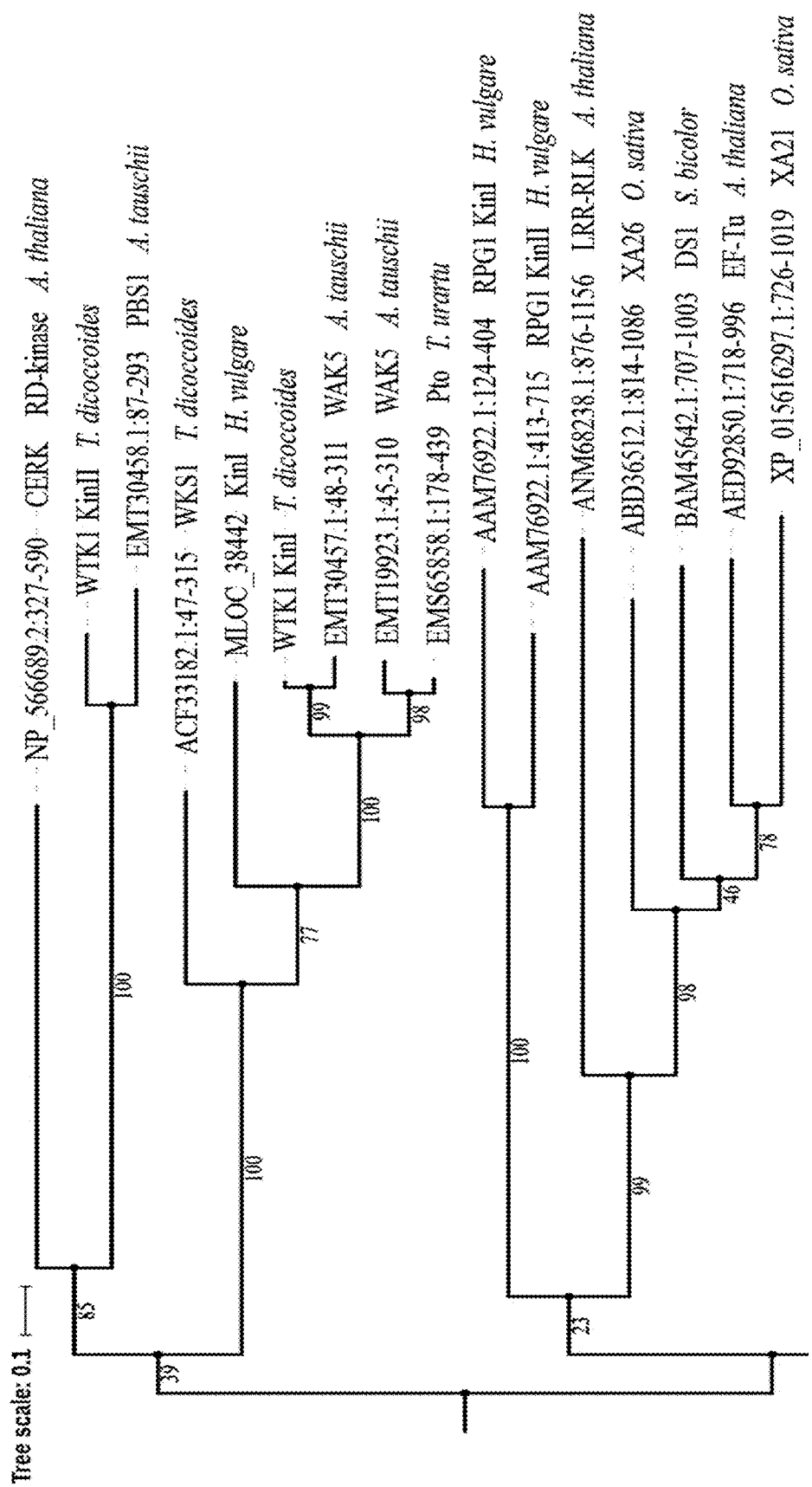
Figure 9:
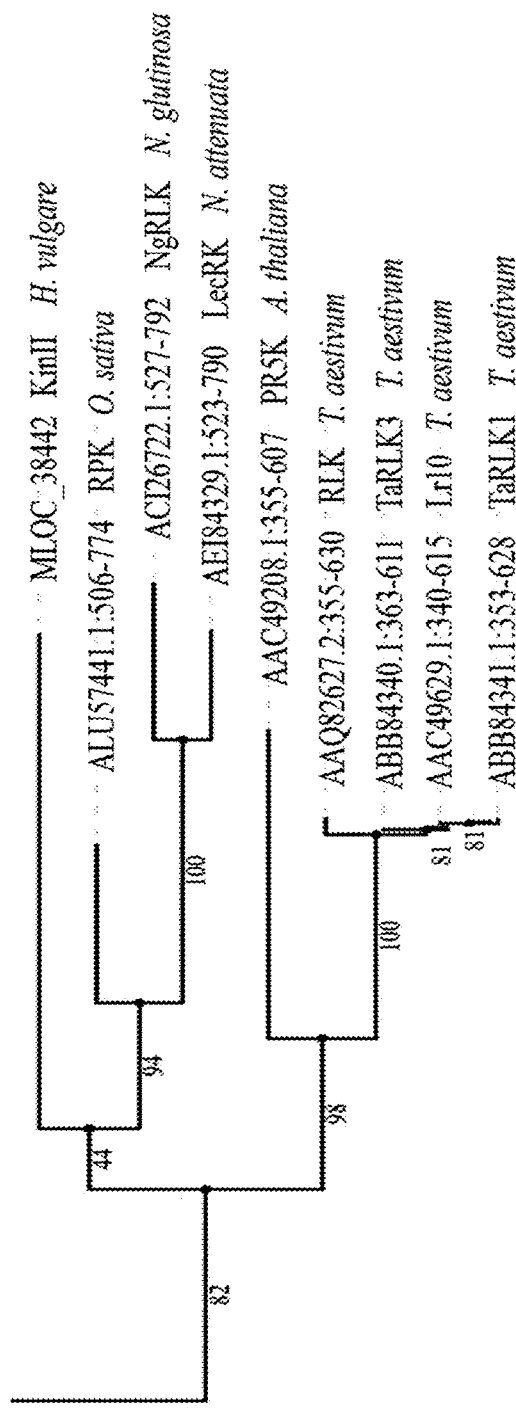

FIG. 9: Phylogenetic analysis of WTK1 and kinase domains from plant pattern recognition receptors (PRRs). A phylogeny tree based on the kinase domain of each protein accession. The location of the domain is indicated by the sequence range numbers after the colon. The numbers at branching points represent the bootstrap values (1000 replicates). Branches are labeled with protein accession numbers, protein abbreviations, and the relevant plant species.

Figure 10:
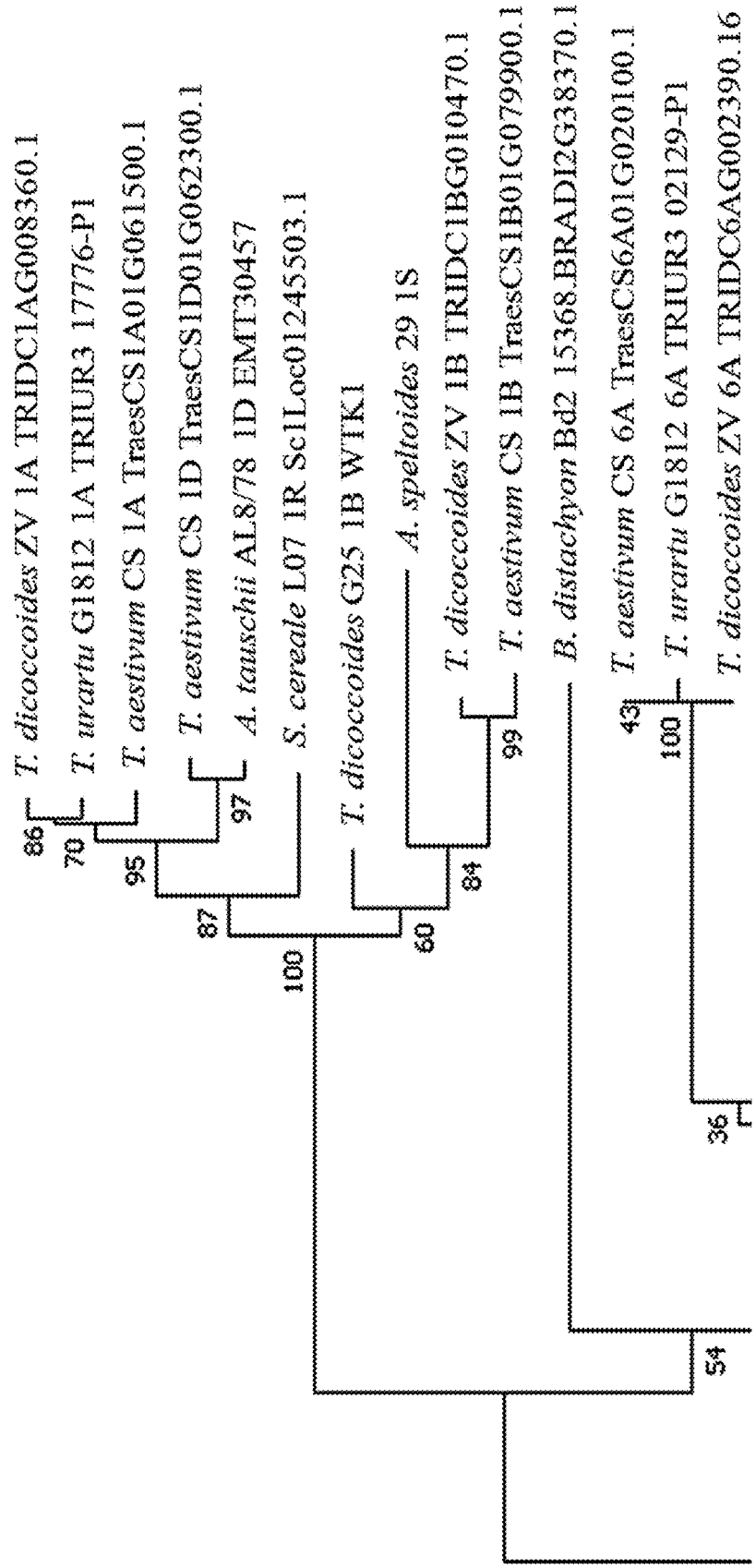
Figure 10:
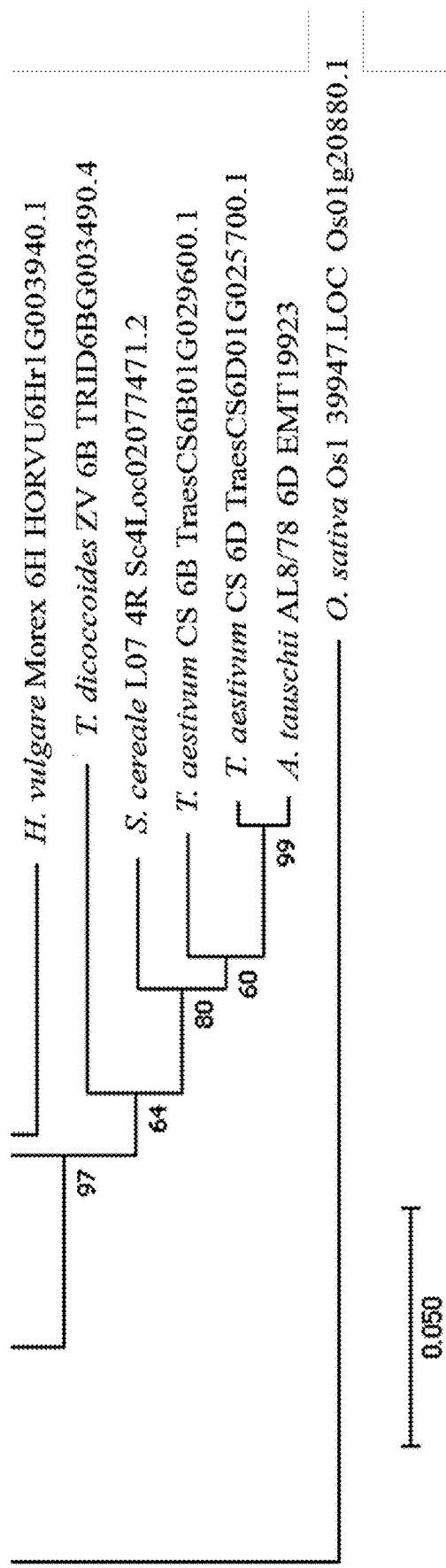

FIG. 10: Phylogeny of Wtk1 orthologs and paralogs in cereal species. A phylogenetic tree of Wtk1 generated using the Neighbor-Joining algorithm based on evolutionary distances calculated using the Poisson correction method. Branches are labeled with the relevant plant species, abbreviation of accession name, chromosome location and protein accession number. The numbers at branching points represent the percentage of replicated trees in which the associated taxa were clustered together in the bootstrap test (10,000 replicates).

Figure 11A:
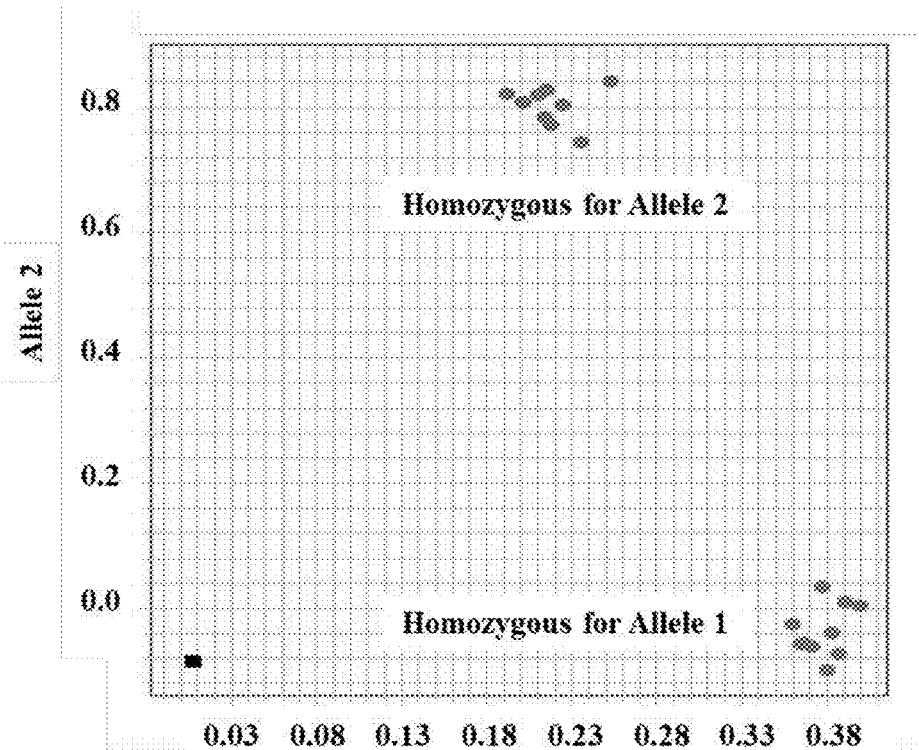
Figure 11B:
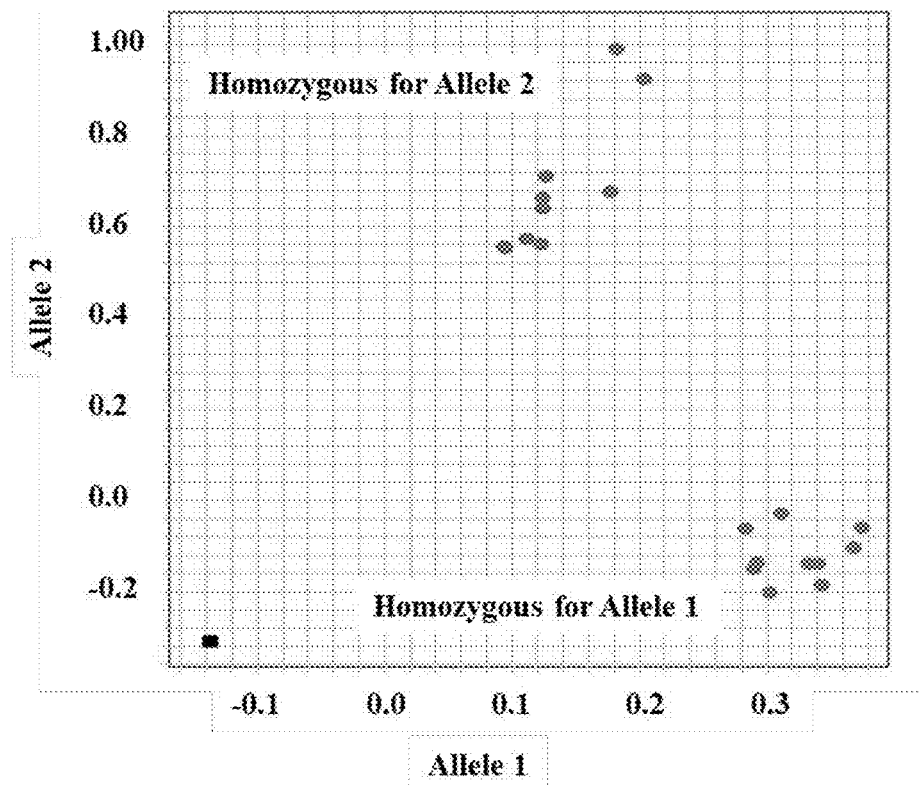

FIGS. 11A-11C: (11A-11B) Allelic discrimination plots showing results of genotyping of 10 susceptible durum and bread wheat lines and 10 Yr15 introgression lines (listed in 11C) with Kin_1 (11A) and Kin_2 (11B) markers.

Figure 12A:
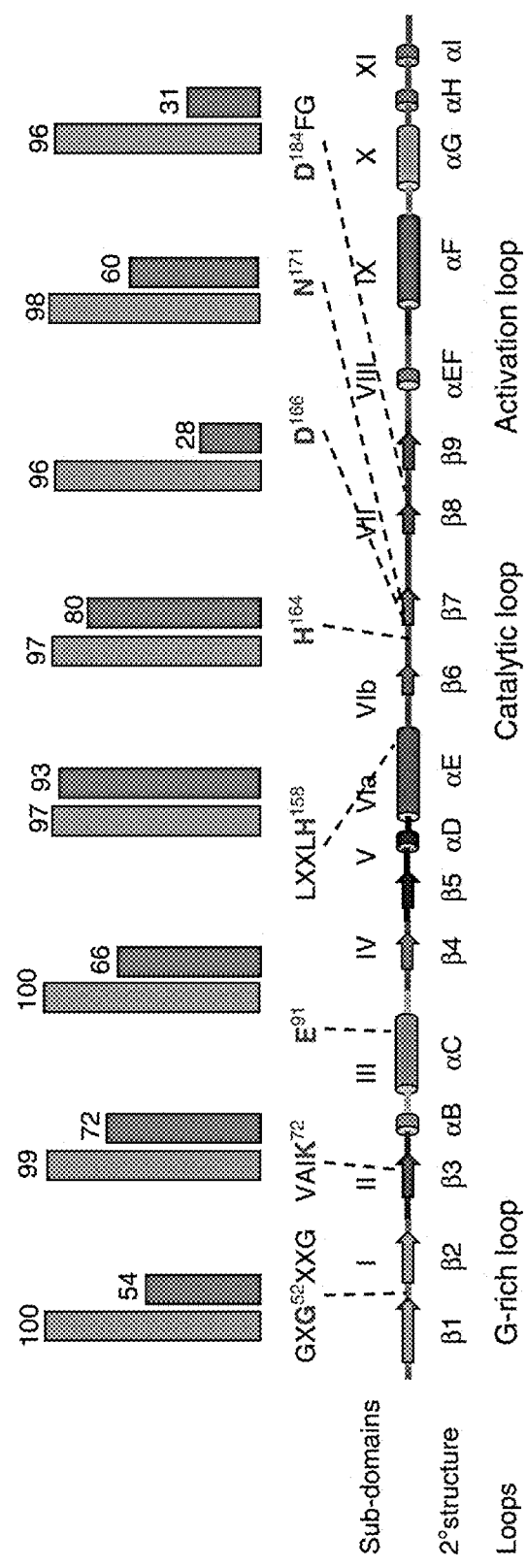
Figure 12B:
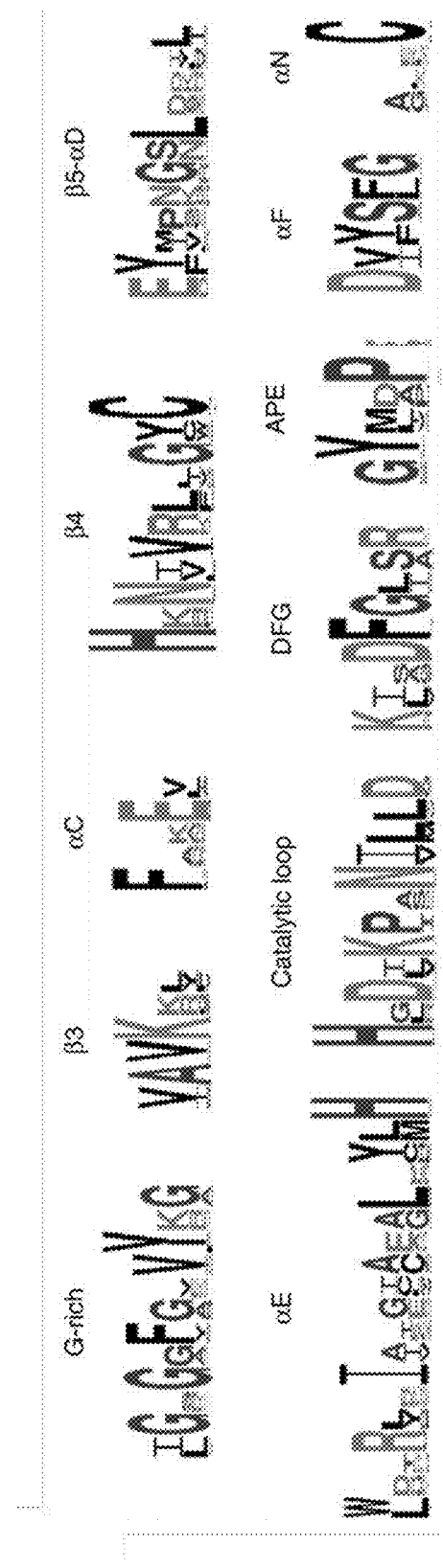

FIGS. 12A-12B: Predicted structures of putative kinase and pseudokinase domains of TKP proteins based on 92 proteins from ten plant species. (12A) Conservation of key motifs, residues, and secondary structure between putative kinase and pseudokinase domains. The secondary structure of a canonical kinase is shown with the standard annotations of its subdomains. Eight key residues are marked, with numbers that are based on their positions in a cAMP-dependent protein kinase catalytic subunit (cAPK). Dashed lines indicate positions within secondary structure elements. The histograms above the motifs represent the degree of conservation (% of identical to conserved residuals) for putative kinase (left columns) and putative pseudokinase (right columns) domains. (12B) Sequence logos representing the conservation of key motifs and neighboring sequences in putative kinase domains. The size of the letters corresponds to their information content.

FIGS. 13A-13B: Phylogenetic analysis of predicted tandem kinase-pseudokinase proteins from across the plant kingdom. (13A) Phylogram of 184 putative kinase domains of TKPs predicted from DNA sequences, which comprise 11 clades and 2 singletons. Each clade is similar to a specific family or sub-family of kinases from Arabidopsis. KinI domains are labeled as K1 (solid line), and KinII domains as K2 (dash line). Clade 1 is similar to LRR_6B (leucine-rich-repeat receptor kinase subfamily 6B). All of the domains in this clade are KinII domains and hence represent fusion TKPs. Clade 2 is similar to RLCK_7 (receptor-like cytoplasmic kinase subfamily 7). All of the domains in this clade are members of wheat TKPs. This clade is composed of two well-supported nodes: one represents two TKPs derived from duplication events, and the second represents three KinII domains from fusion events. Clade 3 is similar to LRR3 (leucine-rich-repeat receptor kinase subfamily 3) and includes highly similar KinII domains from wheat, rye and Sorghum. Clade 4 is similar to RLCK_8 (receptor-like cytoplasmic kinase subfamily 8) and includes only KinII domains. One node comprised of 1BS WTK1 from WEW and orthologs of T. aestivum group 1 chromosomes, and a second node with paralogs of group 6 chromosomes of T. aestivum and H. vulgare. Clade 5 is similar to the WAK family (cell wall-associated kinases) and includes a well-supported node with a cluster of KinI domains, four strongly supported nodes of KinII domains, and three singletons that are not resolved from the base of Clade 10. Clade 6 is similar to L-LPK (concanavalin A-like lectin protein kinases). The clade derives from a single ancient duplication event (includes monocots and dicots) and contains two large sub-clades of KinI and KinII, respectively. Clade 7 is related to RK_1 sub-family (other kinases with no published family) and includes one TKP from maize; and KinI of potato. Clade 8 is similar to RK_1 sub-family (other kinases with no published family) and includes KinII of barley MLOC 36442 as well as its homolog from rice. Clade 9 is similar to the RLCK_7 sub-family (receptor-like cytoplasmic kinase subfamily 7) and is composed of a single pair of domains from rapeseed. Clade 10 is similar to the LRR_12 sub-family (leucine-rich-repeat receptor kinase subfamily 12) and contains one TKP comprised of very similar KinI-KinII pair from rice. Clade 11 is comprised of two large clusters: 11.1 is similar to soluble kinases and includes members of five families: the MAP3K-raf sub-family (raf-like MAPK kinase kinase) from rapeseed and moss; the CDK family (cyclin dependent kinases); the AGC family (cATP-, cGTP- and phospholipid-dependent kinases) from rapeseed; as well as a KinII of the SnRK3 family (SNF1-related kinase 3) from barley and KinII of the MAP3K family (MAP3K kinase) from *Sorghum*. 11.2 constitutes a large group of TKPs, corresponding to the LRR_8B sub-family (cysteine rich kinases). This cluster includes three singletons and five nodes. Singletons contain two KinI domains from rye and *Sorghum* and KinII domain from maize. The largest node includes KinI domains from wheat, barley, rye, and maize. The next three nodes include a mix of KinI and KinII of four TKPs from maize, and single TKPs from barley, rye and *Sorghum*. The last node includes the barley RPG1 KinI and KinII, their paralogs on chromosome 7H, and some homologs in wheat represented by KinI domains and both domains from *Sorghum*. The origins of sequences are coded as follows: Traes, wheat, *T. aestivum*; HORVU, barley, *H. vulgare*; Os, rice, *O. sativa*; AQK and ONM, maize, *Z. mays*; Sc, rye, *S. cereale*; SOBIC, *Sorghum, S. bicolor*; PGSC, potato, *S. tuberosum*; Potri, black cottonwood, *Populus trichocarpa*; Bna, rapeseed or canola, *Brassica napus*; AT, *A. thaliana*; Pp, moss, *Ph. patens*. (13B) Combinations of domains from kinase families and subfamilies resulted in tandem kinase-pseudokinase architecture of TKP family members.

FIG. 14: Phenotyping of Yr15 and Yr5 introgression lines at 19 dpi with Pst races DK92/02 and AU85569. Micrographs showing Pst race DK92/02 showed partial virulence on Yr15 introgression lines, Pst race AU85569 was virulent on Yr5 introgression lines, while introgression lines that contained both Yr15 and Yr5 genes were resistant to both races.

Figure 15A:
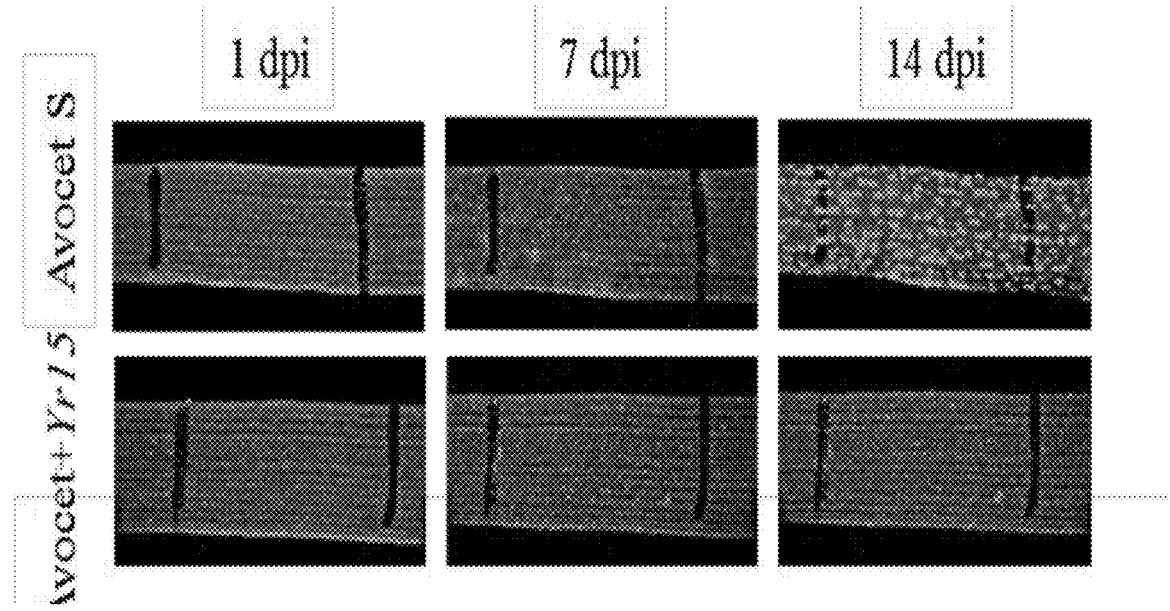
Figure 15B:
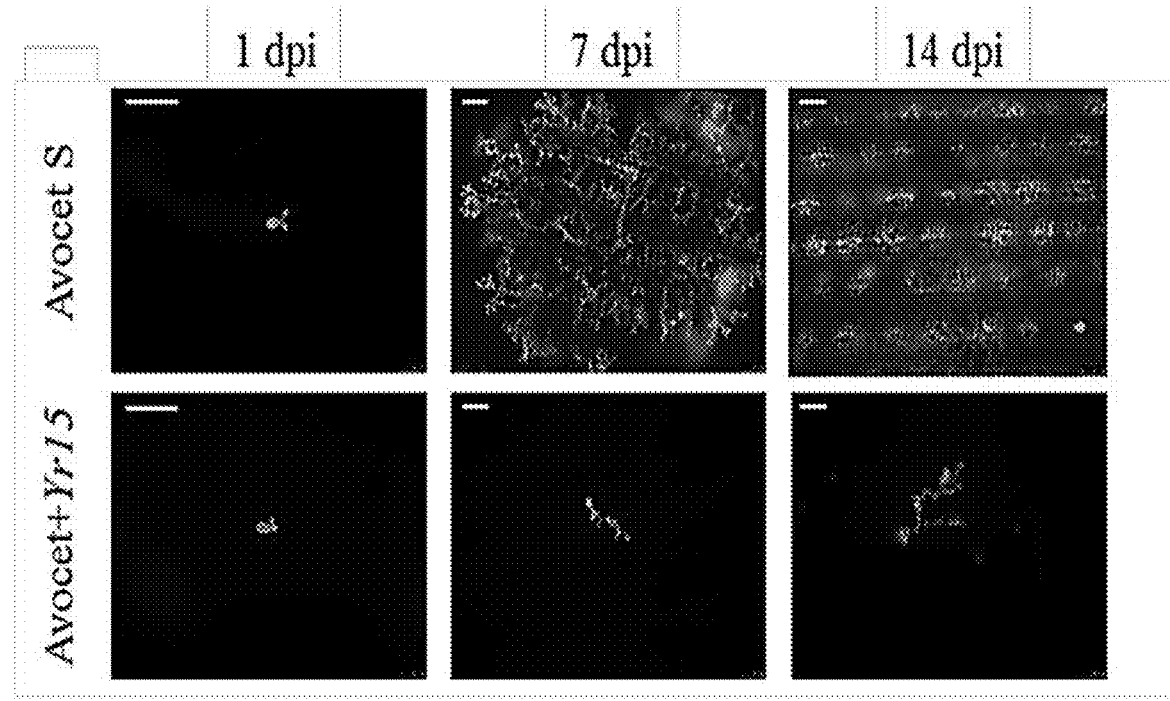
Figure 15C:
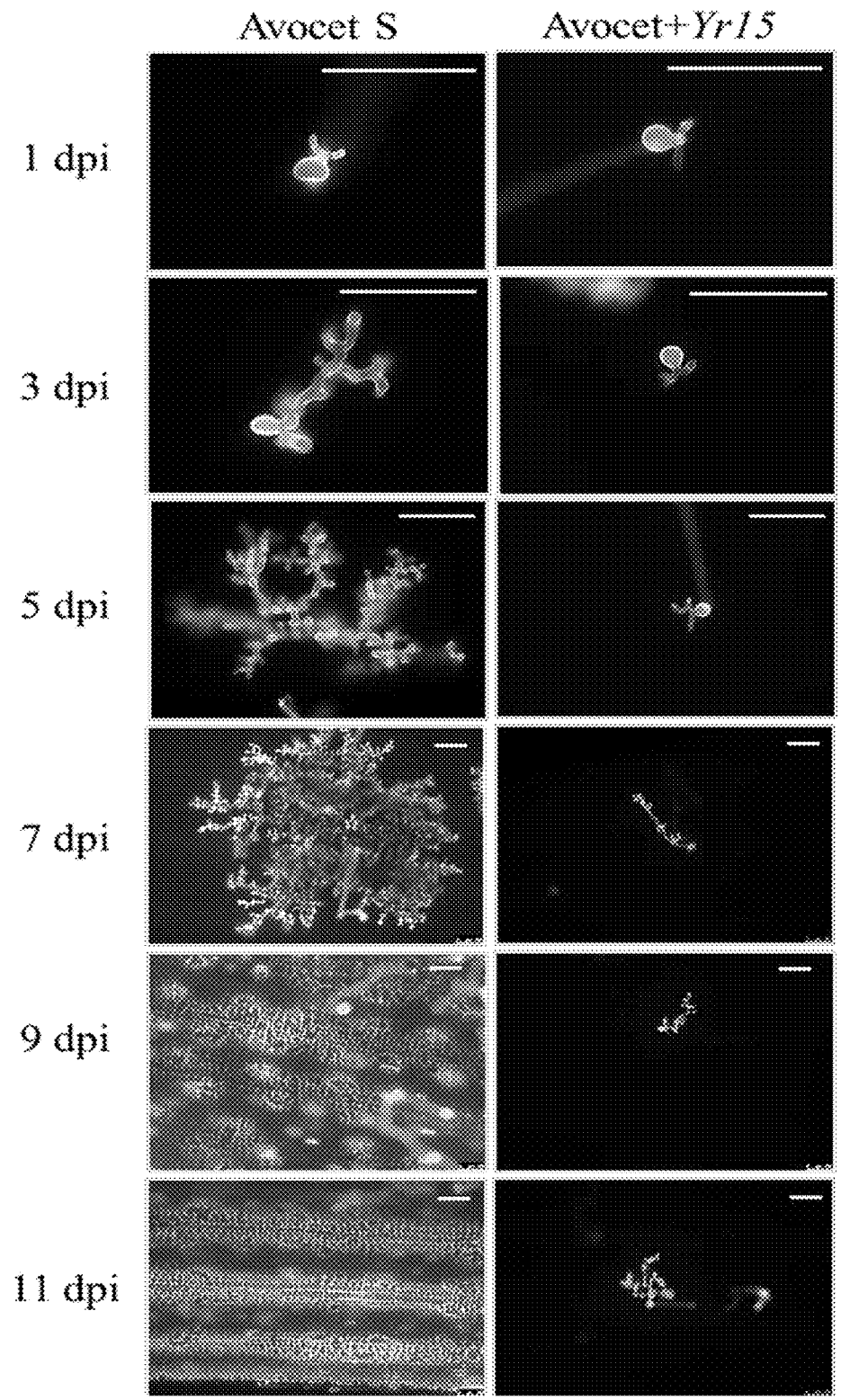
Figure 15D:
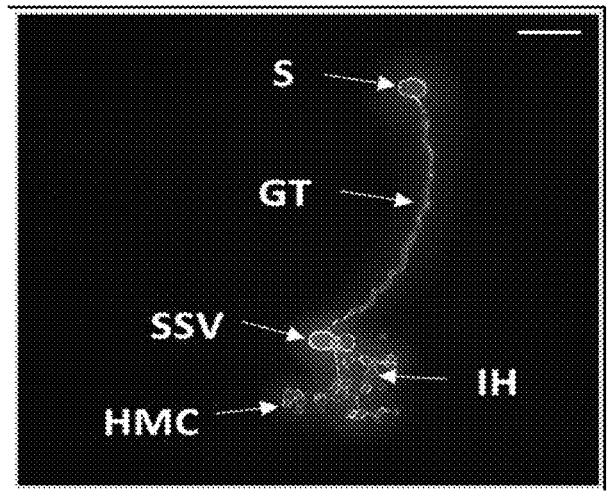
Figure 15E:
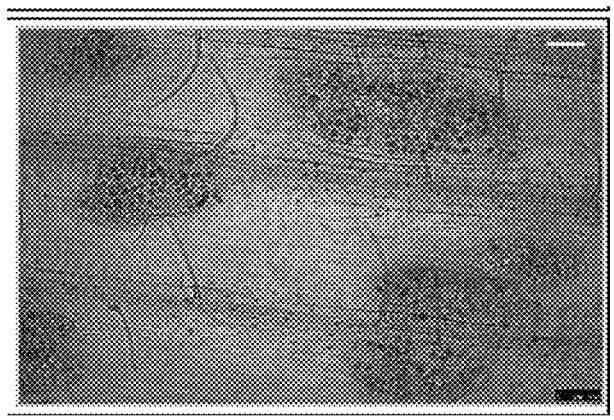
Figure 15F:
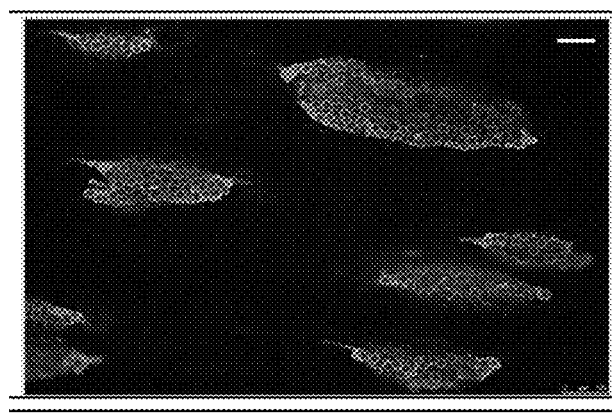
Figure 15G:
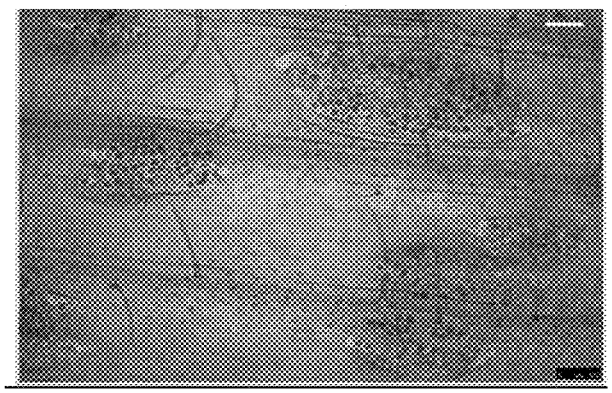

FIGS. 15A-15B: Comparison of fungal development in Pst infected Avocet S and Avocet+Yr15 NILs along 14 days post inoculation (dpi). (15A) Micrographs at 1, 7, and 14 dpi in susceptible and resistant NILs. The black marker lines delineate a 1 cm leaf segment in the middle of second leaf of the same plant. (15B) Fluorescence microscopy observation of fungal colonies and feeding structures at 1, 7, and 14 dpi in susceptible and resistant NILs. Bars=100 μm.

FIGS. 15C-15G: Development of Pst within the leaves of susceptible Avocet S and resistant Avocet+Yr15 NILs at different time points post inoculation. Micrographs showing (15C) fungal growth within leaf tissues in susceptible Avocet S and resistant Avocet+Yr15 host plants at 1, 3, 5, 7, 9, 11 dpi; (15D) 3D structure of a Pst colony formed in Avocet S line at 3 dpi on the surface and inside the leaf tissue; (15E-15G) Uredinias with urediniospores observed in Avocet S at 14 dpi: (15E) the leaf surface observed under a non-fluorescent filter, (15F) fungal uredinias observed under fluorescence, (15G) superimposition of C and D. Bars=100 μm; S, urediniospore; GT, germ tube; SSV, substomatal vesicle; IH, infection hyphae; HMC, haustorial mother cell.

Figure 15H:
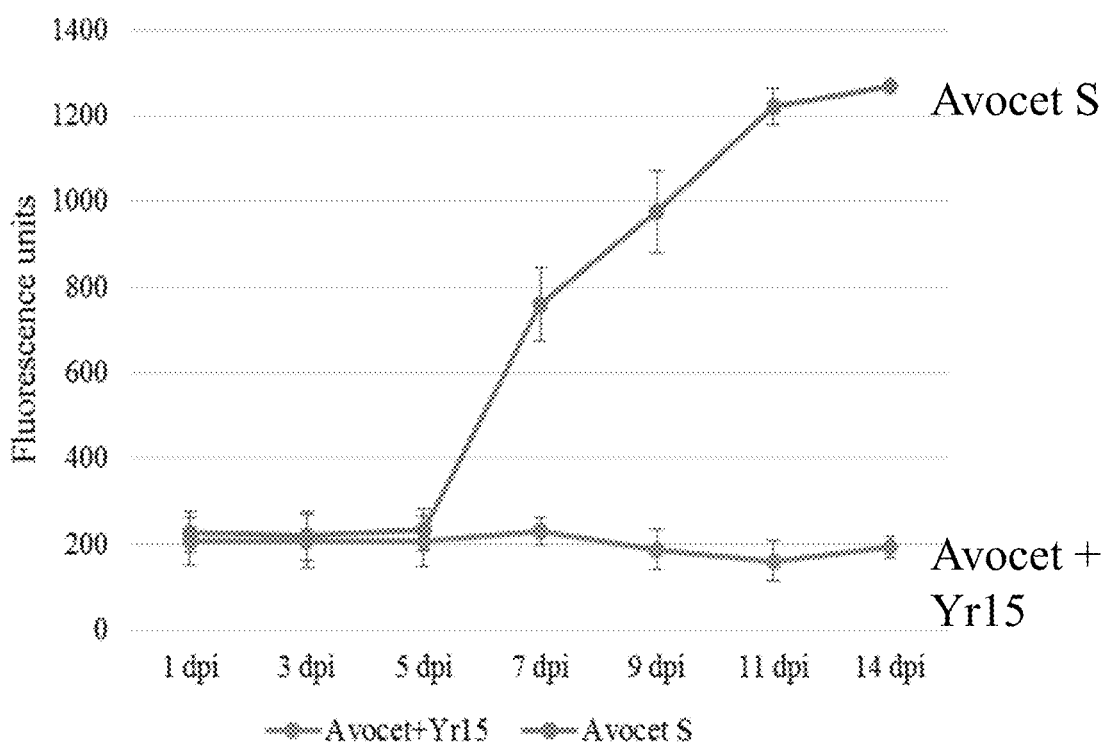

FIG. 15H: A line graph depicting comparative amounts of fungal biomass (chitin) within leaf tissue of NILs during 1-14 dpi. Error bars denote standard error of the mean SEM based on eight biological and three technical replicates.

Figure 15I:
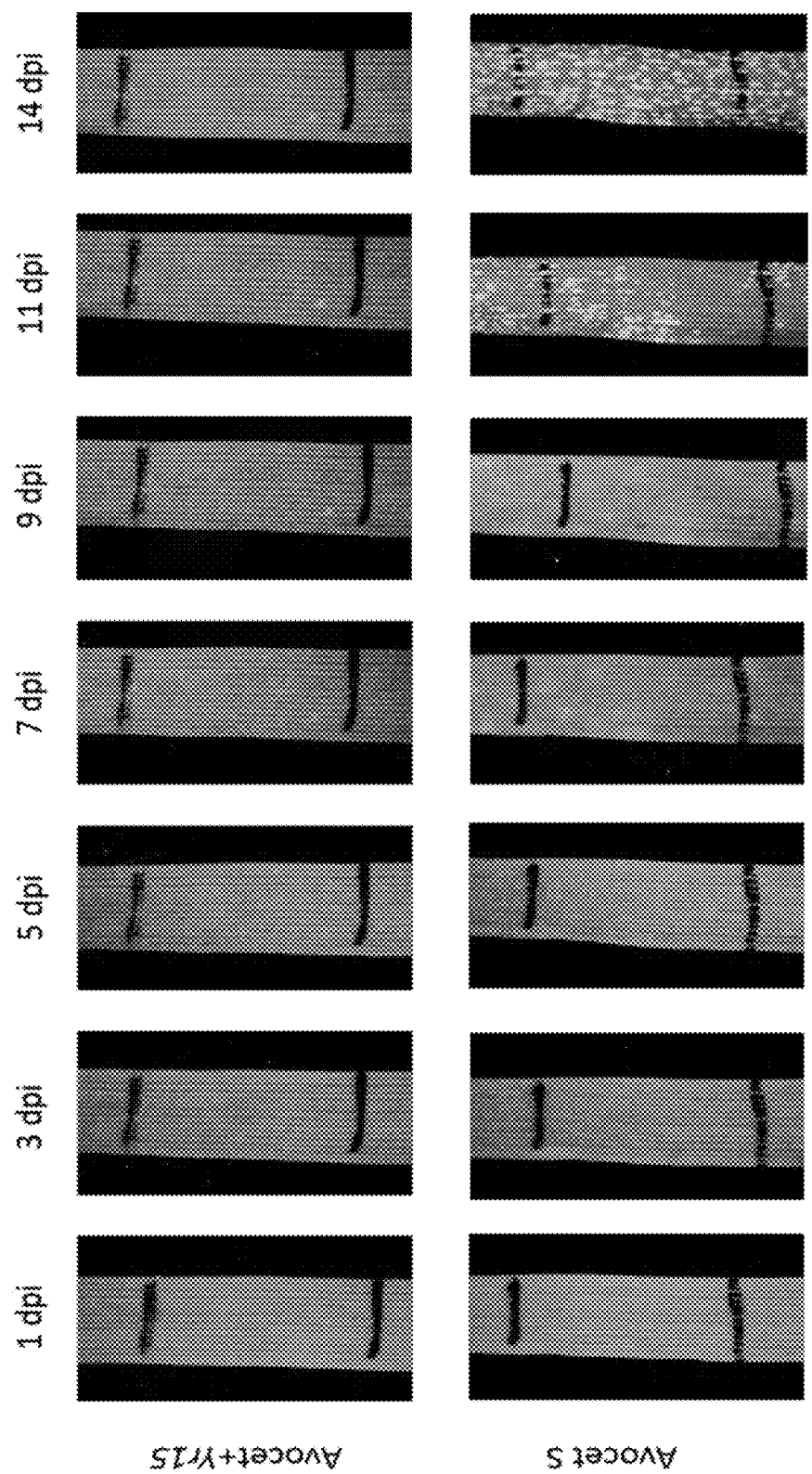

FIG. 15I: Macroscopic observations of symptom development during 14 dpi with Pst isolate #5006 in the susceptible line Avocet S as compared to the resistance response of its NIL Avocet+Yr15. Micrographs show leaves with black marker lines delineating a 1 cm segment in the middle of the second leaf of the same plant followed during 14 days.

DETAILED DESCRIPTION OF THE INVENTION

The present invention provides isolated DNA of the Wtk1 gene or a functional equivalent capable of conferring resistance to stripe ruse (Pst). Artificial vectors comprising same and proteins encoded by same are also provided, as are transgenic plants, and plant tissues and parts therefore which express Wtk1 or a functional equivalent.

The present invention further provides nucleic acid molecules and primers, as well as methods of use thereof, for differentiating between functional Wtk1 and non-functional WtK1, wherein functional Wtk1 confers resistance to Pst.

The present invention is based, in part, on the surprising finding that the genomic region containing the predicted Yr15 gene, which confers stripe rust-resistance, contains an open region frame for a Wheat Tandem Kinase (Wtk1) gene, which encodes a novel non-membrane-bound tandem kinase protein (WTK1) which actually confers the resistance. Further, this protein confers a broad resistance to Pst strains, including many of the new highly virulent forms of Pst. Both kinase domains are required for this resistance, and multiple wtk1 non-functional alleles with mutations in the coding region lack a Pst-resistance phenotype and are found in many domesticated species that are susceptible to Pst. Furthermore, the primers of the invention are able to distinguish between these non-functional alleles and/or pseudogenes and the functional Wtk1.

As used herein, "Pst" refers to stripe rust, which is also called *Puccinia striiformis* f sp. *tritici*. In some embodiments, Pst comprises all strains of stripe rust. In some embodiments, Pst comprises European stripe rust. In some embodiments, Pst comprises the Warrior race (e.g. DK09/11) of stripe rust.

The Wtk1 Functional Gene

As used herein, "Wtk1" refers to a functional Wtk1 gene, which confers resistance to Pst. As used herein, "wtk1" refers to a non-functional wtk1 gene, which does not confer resistance to Pst. The term "gene" is used broadly to refer to any nucleic acid associated with a biological function. Thus, the term "gene" includes coding sequences (CDS) and/or regulatory sequences required for expression. The term "gene" can also apply to a specific genomic sequence, as well as to a cDNA or an mRNA encoded by that genomic sequence.

In some embodiments, the functional Wtk1 gene comprises the Wtk1 CDS. In some embodiments, the Wtk1 CDS consists of the nucleic acid sequence

```
(SEQ ID NO: 1)
atggattaccaaggaaacaattttaatgatttctttcaaactaatgggca ttttgtacttaaaagagtggacaacaactataaactgcggtcattcactg aaaaggagatagagcacattacagacagatatagcacttcgcttggtaat ggctcgttcggtgatgtctacaaaggaagattagacgatcaacgtccagt cgcagtaaagagatacaaaaatggaaccaagaagaggagtttgccaagg aggtgatagtgcattcccagataaaccataagaacgttgtcagattgtta ggctgctgcacagaggaaatgctcttatgattgttatggagtttatctg taatggaaacctctacaacatccttcactgtggcaatgcagatggtccta tccccttcccttggacaaacgtttggacatcgccatcgagtcagcggaa gcactatcatgcatgcattcaatgtacagtcctgtccttcatggtgacat
``` taaacctgccaatatactgttggatgaaaagtacttgccaaagctatctg attttggaatagcaagactgctttctactgatgaggcccagcgtaccaaa actgttattggttgcataggttatgtagaccctttgttttgtcagagcgg tattctaactacaaagagtgatgtatacagttttggagttgttctgttgg aaatgatcacccgaaaaaaagcgacggatggggctactagtcttactcaa tgtttcgccgaggccctgggagggaagaaggtgagacaattgtttgatgt ggaaattgccaatgacaagaagaaggtgaaattgatcgaagatattgcga agttagcagctacatgcttgaaactggaggataaaatgcgtccgacaatg gttgaggtagcagatagacttaggaggattagaaaagctctcccccagcg caagggtgaaagctctacaggcatcaacaatgggctcataagaacaggaa aggcagaggatctaccaactatttcccttgatgaaatgaagaaactaaca agaaacttcagtgatggtgctctaataggagagagctcacaaggcagagt tttgttcgaagagttaagttatggaaagagatatgcattcaagtcttctc aagaaattgatttgaagattgaagcaatttcaagactgaaacacaagaac gttgtccaacttctcggaaattgggtcgaaggaaacaaatatgttcttgc ttacgagtatgtatcggggggcacgttgcatgatattcttcacagagagg gtgataagggtgtcagtggagccaggccaggagcagctctatcatggatg cagagagtgaagattgccttaagtgcagcagaagggcttgagttcctcca tcagaaggcagagcctcaggtcacccacggtaacatcatgtccagcaaga tacttctctttgacaaagataatgcaaaggttggcggcgttggtatctcc aatgtactggtgcgtgataacatggttcactgtcacagttttagacagga ctgtgacatggatcgtatggatggtattcgttatcacccagatgattact atgtcgatctatatgctgctactggacagtgtaacgcaaagagcgatgta tacgccttcggggttgtgctgctggagcttttaaccggtcgcgaggcagt tgatcatgcactacccaaaggcaagcagagcctcgtgacatgggtataca accatggcgaggagaaaagcccatggagatgggaaaacaatattatggaa gacaatgtgttaacaaaaacaagttttagtgaagatatggtgcagcgatg cgtggatccaaggcttaaaggatattaccatcgcagtgctgttaccaaga tgggtgcgatcgcgtcgctatgcgtgaattacaatccagatctccgacca aacatgagcactgtcgtcaagggtctgaggcaattgttgcaaaagtga.

In some embodiments, the Wtk1 CDS comprises SEQ ID NO: 1.

In some embodiments, the functional Wtk1 gene comprises the Wtk1 genomic sequence which consists of the nucleic acid sequence (SEQ ID NO: 3)
atggattaccaaggaaacaattttaatgatttctttcaaactaatgggca ttttgtacttaaaagagtggacaacaactataaactgcggtcattcactg aaaaggagatagagcacattacagacagatatagcacttcgcttggtaat ggctcgttcggtgatgtctacaaaggaagattagacgatcaacgtccagt cgcagtaaagagatacaaaaatggaaccaagaaagaggagtttgccaagg aggtgatagtgcattcccagataaaccataagaacgttgtcagattgtta ggctgctgcacagaggaaaatgctcttatgattgttatggagtttatctg taatggaaacctctacaacatccttcactgtggcaatgcagatggtccta tcccttccctttggacaaacgtttggacatcgccatcgagtcagcggaa gcactatcatgcatgcattcaatgtacagtcctgtccttcatggtgacat taaacctgccaatatactgttggatgaaaagtacttgccaaagctatctg attttggaatagcaagactgctttctactgatgaggcccagcgtaccaaa actgttattggttgcataggttatgtagaccctttgttttgtcagagcgg tattctaactacaaagagtgatgtatacagttttggagttgttctgttgg aaatgatcacccgaaaaaaagcgacggatggggctactagtcttactcaa tgtttcgccgaggccctgggagggaagaaggtgagacaattgtttgatgt ggaaattgccaatgacaagaagaaggtgaaattgatcgaagatattgcga agttagcagctacatgcttgaaactggaggataaaatgcgtccgacaatg gttgaggtagcagatagacttaggaggattagaaaagctctcccccagcg caagggtgaaagctctacaggtaattaagaagagtaaaatgcattggcag tcactgctctacttcaaagtttacgtggctttttgcttagctactgatgt cagacgtggataacaacacggtatatgcagtagggtgggatgcgaaataa acaaacctagctgcttcttttaatactttgtttatgtgtaggattacg cacaagtaatttcagtacttgtttgggtgaaaggaaaaatacacaaactt ttattttcttcttttaagcacttaagtactcaaatacttcctttgtccag tgtgggagtgtcaaaaaacgtcttacgttatgggacggagggagtacatg aatatagccttcgtaggtaatttaagaaattatccttttcctgttagcat ggccatttaacgaaattcttttcctttcaactatgttaggtctgtagtct ccttagttgtttctgtatgtattgaatcgttttagactaaagtgcatgga atgtttaaaaatcttagtttgagtacatacgtggagttttaaggtacctc atgcattttacttttctttttaagtatattatacaattttaagtataagt agtcggacccttccccggaccctgcgctagcaggagctacatgcaatggg ctgcccttttttttttataagagtggactcatcaaaatgaatattatgtat atttaggttaaagacgaaccagtttgccaaaataaatgtactggttcaga agggtacatgccacccttgttttcattcccaatccttgtgtgctaccagg gttcatgtccatgccaatcacataaaacacaatttactctaagcgtgtca caaatcataagtaatgaaactttacctcactagtaaatctgtacgtgcaa tgcatgttgatattaggcaaatatattaattgcacgcggatattaggtag ggtattatttgcgtgtttattatgggattagcattgttatttatatttga atgatattaactgcatgctaaacgtgttgagtgctcaccattgcggagca gcctaagtcgttggattgacctagattgatggccgagatttgttggatct gcccctttgggtctttttatattgatgatatagatagatatagattatat gagaccgttatttatttatgtcttccccaatgcaggcatcaacaatgggc tcataagaacaggaaaggcagaggatctaccaactatttcccttgatgaa atgaagaaactaacaagaaacttcagtgatggtgctctaataggagagag ctcacaaggcagagttttgttcgaagagttaagttatggaaagagatatg cattcaagtcttctcaagaaattgatttgaaggttatggttccgagcctt

```
acctttcaccatttctactgacactcttcatttattagtacagaaaggt
cttgccttctaactggcacatttccgtggcagattgaagcaatttcaaga
ctgaaacacaagaacgttgtccaacttctcggaaattgggtcgaaggaaa
caaatatgttcttgcttacgagtatgtatcgggggcacgttgcatgata
ttcttcacagagagggtgaggaactatacaattttacttttcggagtaa
catgctgcatgcctttttattgaaaggggaatagtttggcaattcaac
gtcagccatgtgaggaacagagcaacactcaaagagctcgcctcctacg
aaaccttaaattttcaaaaaatagtttagtgcgtctggtatgtgaggcg
gggacatattttgttaacatcacttacctgctttgaatatacaatatgat
aaaagtaaaaatttctccaatattattctggtttatggtcacaggtgata
agggtgtcagtggagccaggccaggagcagctctatcatggatgcagaga
gtgaagattgccttaagtgcagcagaagggcttgagttcctccatcagaa
ggcagagcctcaggtcacccacggtaacatcatgtccagcaagatacttc
tctttgacaaagataatgcaaaggttggcggcgttggtatctccaatgta
ctggtgcgtgataacatggttcactgtcacagttttagacaggactgtga
catggatcgtatggatggtattcgttatcacccagatgattactatgtcg
atctatatgctgctactggacagtgtaacgcaaagagcgatgtatacgcc
ttcggggttgtgctgctggagcttttaaccggtcgcgaggcagttgatca
tgcactacccaaaggcaagcagagcctcgtgacatgggtatacaaccatg
gcgaggagaaaagcccatggagatgggtatgcatccgtgtattcattgat
tcgtgtgtataatgtcttgacaaggtgcattagctaaactattgatgact
tgatgcacaggaaaacaatattatggaagacaatgtgttaacaaaaaca
agttttagtgaagatatggtgcagcgatgcgtggatccaaggcttaaagg
atattaccatcgcagtgctgttaccaaggtatgtaatttatcctgaactc
taccatgtttaagtttaaccgagtaaactagtggtgaatcctgggcaatg
gtgcggggagatatcattttcgaaccattgtagtctattccaccaaataa
gcaggatttaatctccattattatactccctctgtctcataatataagac
gttgatgtaataacgtcttatgttatggcacagaaggagtaagagttaat
tcaacattttagccccaagtttgtcagggtaccccctgttctaaattcaa
ttcggaccatcttgtaccacaaagtttcaaatttgttcaccaccgggaag
ggaagaagtagtagccccacaatcctgcgttggtcctcttcatcatggct
cctcccgatctcatcatggcccatcgcttcgcacggtcactgctcttccc
atgtcagtcttgctatgcggcagtaagttggcacgccacctcagcctaac
agcgggtctgggctgctataagagtggaatttctcctgggtaaatacc
agtacaaatttgaaaactgaggataaatcttctgggaacaaagataaact
cactcgtgtgaagagcatccagtgaggcaaagaaaaccggtaatctattg
cacaaaaagcttcacaggaagcaacgacaatcaatccaggtaacatgtta
agactatgcaggaggcaaacaagtgacatgaacacttgtgcaaacagctc
caggaagcctattcatcaggaaccgctccagaaccgccatcttgattaat
agcgtacagtgcattaagccttgaaggaaccgtgaccaccctcctttggc
ttgagattgtctttttgagtttcaccagccgtgctgctccttgtttcata
tccttctgcattacagaaattagcgcgttataatcttgattgaatgacta
gctaggggtaaaaagatgaaactaagttttagtataatctttgagttct
tgagctatgagggaccaagtgactgctctcctgattactttcttcttttg
gcaagcagatgggtgcgatcgcgtcgctatgcgtgaattacaatccagat
accgaccaaacatgagcactgtcgtcaagggtagaggcaattgttgcaaa
agtga.
```

In some embodiments, the Wtk1 genomic sequence comprises SEQ ID NO:3. In some embodiments, the Wtk1 genomic sequence comprises the genomic sequence of Wtk1 and 2 kilobases upstream and/or downstream from that sequence.

In some embodiments, the Wtk1 CDS is a cDNA reverse transcribed from an RNA which codes for the amino acid sequence

```
                                            (SEQ ID NO: 2)
MDYQGNNFNDFFQTNGHFVLKRVDNNYKLRSFTEKEIEHITDRYSTSLGN
GSFGDVYKGRLDDQRPVAVKRYKNGTKKEEFAKEVIVHSQINHKNVVRLL
GCCTEENALMIVMEFICNGNLYNILHCGNADGPIPFPLDKRLDIAIESAE
ALSCMHSMYSPVLHGDIKPANILLDEKYLPKLSDFGIARLLSTDEAQRTK
TVIGCIGYVDPLFCQSGILTTKSDVYSFGVVLLEMITRKKATDGATSLTQ
CFAEALGGKKVRQLFDVEIANDKKKVKLIEDIAKLAATCLKLEDKMRPTM
VEVADRLRRIRKALPQRKGESSTGINNGLIRTGKAEDLPTISLDEMKKLT
RNFSDGALIGESSQGRVLFEELSYGKRYAFKSSQEIDLKIEAISRLKHKN
VVQLLGNWVEGNKYVLAYEYVSGGTLHDILHREGDKGVSGARPGAALSWM
QRVKIALSAAEGLEFLHQKAEPQVTHGNIMSSKILLFDKDNAKVGGVGIS
NVLVRDNMVHCHSFRQDCDMDRMDGIRYHPDDYYVDLYAATGQCNAKSDV
YAFGVVLLELLTGREAVDHALPKGKQSLVTWVYNHGEEKSPWRWENNIME
DNVLTKTSFSEDMVQRCVDPRLKGYYHRSAVTKMGAIASLCVNYNPDLRP
NMSTVVKGLRQLLQK.
```

In some embodiments, the Wtk1 CDS is a cDNA reverse-transcribed from an RNA which codes for a polypeptide comprising a first kinase-like domain (KinI) of Wtk1 and a nucleic acid sequence that encodes a second kinase-like domain (KinII) of Wtk1. Each possibility represents a separate embodiment of the invention. In some embodiments, the KinI consists of the amino acid sequence

```
                                            (SEQ ID NO: 4)
DRYSTSLGNGSFGDVYKGRLDDQRPVAVKRYKNGTKKEEFAKEVIVHSQI
NHKNVVRLLGCCTEENALMIVMEFICNGNLYNILHCGNADGPIPFPLDKR
LDIAIESAEALSCMEISMYSPVLHGDIKPANILLDEKYLPKLSDFGIARL
LSTDEAQRTKTVIGCIGYVDPLFCQSGILTTKSDVYSFGVVLLEMITRKK
ATDGATSLTQCFAEALGGKKVRQLFDVEIANDKKKVKLIEDIAKLAATCL
KLEDKMRPTMVEVADRLRRI.
```

In some embodiments, the KinII consists of the amino acid sequence

```
                                              (SEQ ID NO: 5)
GESSQGRVLFEELSYGKRYAFKSSQEIDLKIEAISRLKHKNVVQLLGNWV

EGNKYVLAYEYVSGGTLHDILHREGDKGVSGARPGAALSWMQRVKIALSA

AEGLEFLHQKAEPQVTHGNIMSSKILLFDKDNAKVGGVGISNVLVRDNMV

HCHSFRQDCDMDRMDGIRYHPDDYYVDLYAATGQCNAKSDVYAFGVVLLE

LLTGREAVDHALPKGKQSLVTWVYNHGEEKSPWRWENNIMEDNVLTKTSF

SEDMVQRCVDPRLKGYYHRSAVTKMGAIASLCVNYNPDLRPNMSTVVKGL

RQLLQK.
```

As used herein, the terms "peptide", "polypeptide" and "protein" are used interchangeably to refer to a polymer of amino acid residues. In another embodiment, the terms "peptide", "polypeptide" and "protein" as used herein encompass native peptides, peptidomimetics (typically including non-peptide bonds or other synthetic modifications) and the peptide analogues peptoids and semipeptoids or any combination thereof. In another embodiment, the peptides, polypeptides and proteins described have modifications rendering them more stable while in the organism or more capable of penetrating into cells. In one embodiment, the terms "peptide", "polypeptide" and "protein" apply to naturally occurring amino acid polymers. In another embodiment, the terms "peptide", "polypeptide" and "protein" apply to amino acid polymers in which one or more amino acid residue is an artificial chemical analogue of a corresponding naturally occurring amino acid.

Isolated DNA

By a first aspect there is provided an isolated DNA comprising a nucleic acid sequence with at least 99%, 97%, 95%, 90%, 85%, 80%, 75%, or 70% homology to the Wtk1 coding sequence. Each possibility represents a separate embodiment of the invention.

By another aspect, there is provided an isolated DNA comprising a nucleic acid sequence with at least 99%, 97%, 95%, 90%, 85%, 80%, 75%, or 70% identity to the Wtk1 coding sequence. Each possibility represents a separate embodiment of the invention.

In some embodiments, the isolated DNA is at least 100%, 99%, 97%, 95%, 90%, 85%, 80%, 75%, or 70% pure. Each possibility represents a separate embodiment of the invention. The purity is with respect to contamination by other DNAs or other cellular components.

In some embodiments, the isolated DNA is a cDNA. In some embodiments, the isolated DNA is an isolated Wtk1 CDNA. In some embodiments, the isolated DNA of the invention comprises a nucleic acid sequence with at least 80% homology to SEQ ID NO: 1. In some embodiments, the isolated DNA of the invention comprises SEQ ID NO: 1.

In some embodiments, the isolated DNA of the invention comprises a fragment or an analog to the Wtk1 gene, wherein the fragment or analog encodes a protein that confers resistance to Pst. In some embodiments, the isolated DNA of the invention comprises a nucleic acid sequence with at least 99%, 97%, 95%, 90%, 85%, 80%, 75%, or 70% homology to a fragment or analog of SEQ ID NO: 1, wherein the fragment encodes a protein that confers resistance to Pst. Each possibility represents a separate embodiment of the invention. In some embodiments, the isolated DNA molecules of the invention encode for a protein that confers resistance to Pst.

In some embodiments, the isolated DNA of the invention comprises a nucleic acid sequence that encodes a peptide comprising SEQ ID NO: 2. In some embodiments, the isolated DNA of the invention comprises a nucleic acid sequence that encodes a peptide with at least 99%, 95%, 90%, 85%, 80%, 75%, or 70% homology or identity to SEQ ID NO: 2 and confers resistance to Pst. Each possibility represents a separate embodiment of the invention.

In some embodiments, the isolated DNA comprises the genomic sequence of Wtk1. In some embodiments, the genomic sequence of Wtk1 comprises SEQ ID NO: 3. In some embodiments, the isolated DNA comprises the genomic sequence of Wtk1 and 2 kilobases (kb) upstream and/or downstream from that sequence. In some embodiments, the isolated DNA comprises regulatory element that control the expression of Wtk1. In some embodiments, the isolated DNA comprises the genomic sequence 3.4 kb upstream and 1 kb downstream of the sequence provided in SEQ ID NO: 3. In some embodiments, the isolated DNA comprises the sequence provided in SEQ ID NO: 117.

As used herein, the term "isolated nucleic acid molecule" refers to a nucleic acid molecule that is essentially free from contaminating cellular components, such as carbohydrate, lipid, or other proteinaceous impurities associated with the nucleic acid in nature. Typically, a preparation of isolated DNA or RNA contains the nucleic acid in a highly purified form, i.e., at least about 80% pure, at least about 90% pure, at least about 95% pure, greater than 95% pure, or greater than 99% pure. In some embodiments, the isolated DNA is cDNA. In some embodiments, the isolated nucleic acid is any one of DNA, RNA, and cDNA. In some embodiments, the isolated nucleic acid molecule is a synthesized nucleic acid molecule. Synthesis of nucleic acid molecules is well known in the art and may be performed, for example, by ligating or covalently linking by primer linkers multiple nucleic acid molecules together.

The term "nucleic acid" is well known in the art. A "nucleic acid" as used herein will generally refer to a molecule (i.e., a strand) of DNA, RNA or a derivative or analog thereof, comprising nucleotides. Nucleotides are comprised of nucleosides and phosphate groups. The nitrogenous bases of nucleosides include, for example, naturally occurring purine or pyrimidine nucleosides as found in DNA (e.g., an adenine "A," a guanine "G," a thymine "T" or a cytosine "C") or RNA (e.g., an A, a G, an uracil "U" or a C).

The term "nucleic acid molecule" includes but not limited to single-stranded RNA (ssRNA), double-stranded RNA (dsRNA), single-stranded DNA (ssDNA), double-stranded DNA (dsDNA), small RNAs, circular nucleic acids, fragments of genomic DNA or RNA, degraded nucleic acids, amplification products, modified nucleic acids, plasmid or organellar nucleic acids, and artificial nucleic acids such as oligonucleotides.

As used herein, the term "analog" includes any peptide having an amino acid sequence substantially identical to one of the sequences specifically shown herein in which one or more residues have been conservatively substituted with a functionally similar residue and which displays the abilities to confer resistance to Pst. Examples of conservative substitutions include the substitution of one non-polar (hydrophobic) residue such as isoleucine, valine, leucine or methionine for another, the substitution of one polar (hydrophilic) residue for another such as between arginine and lysine, between glutamine and asparagine, between glycine and serine, the substitution of one basic residue such as lysine, arginine or histidine for another, or the substitution of one acidic residue, such as aspartic acid or glutamic acid for another. Each possibility represents a separate embodiment of the present invention.

In some embodiments, the isolated DNA of the invention comprises a nucleic acid sequence that encodes a first kinase-like domain (KinI) of Wtk1 and a nucleic acid sequence that encodes a second kinase-like domain (KinII) of Wtk1. Each possibility represents a separate embodiment of the invention. In some embodiments, the KinI consists of SEQ ID NO: 4. In some embodiments, the KinII consists of SEQ ID NO: 5. In some embodiments, the isolated DNA comprises a nucleic acid sequence encoding SEQ ID NO: 4 and SEQ ID NO: 5. In some embodiments, the DNA encoding SEQ ID NO: 4 and SEQ ID NO:5 are separated by a spacer. In some embodiments, the spacer is at least 3, 6, 9, 12, 15, 18, 21, 24, 27 or 30 base pairs. Each possibility represents a separate embodiment of the invention. In some embodiments, the spacer has a nucleic acid bases in a multiple of 3 such that the KinII will be encoded in frame.

In some embodiments, the isolated DNA of the invention comprises a nucleic acid sequence with at least 99%, 97%, 95%, 90%, 85%, 80%, 75%, or 70% homology to DNA encoding KinI of Wtk1 and a nucleic acid sequence with at least 99%, 97%, 95%, 90%, 85%, 80%, 75%, or 70% homology to the DNA encoding KinII of Wtk1. Each possibility represents a separate embodiment of the invention. In some embodiments, the DNA encoding KinI of Wtk1 is (SEQ ID NO: 6)

```
gacagatatagcacttcgcttggtaatggctcgttcggtgatgtctacaaa ggaagattagacgatcaacgtccagtcgcagtaaagagatacaaaaatgga accaagaaagaggagtttgccaaggaggtgatagtgcattcccagataaac cataagaacgttgtcagattgttaggctgctgcacagaggaaaatgctctt atgattgttatggagtttatctgtaatggaaacctctacaacatccttcac tgtggcaatgcagatggtcctatccccttccctttggacaaacgtttggac atcgccatcgagtcagcggaagcactatcatgcatgcattcaatgtacagt cctgtccttcatggtgacattaaacctgccaatatactgttggatgaaaag tacttgccaaagctatctgattttggaatagcaagactgctttctactgat gaggcccagcgtaccaaaactgttattggttgcataggttatgtagaccct ttgttttgtcagagcggtattctaactacaaagagtgatgtatacagtttt ggagttgttctgttggaaatgatcacccgaaaaaaagcgacggatggggct actagtcttactcaatgtttcgccgaggccctgggagggaagaaggtgaga caattgtttgatgtggaaattgccaatgacaagaagaaggtgaaattgatc gaagatattgcgaagttagcagctacatgcttgaaactggaggataaaatg cgtccgacaatggttgaggtagcagatagacttaggaggatta.
```

In some embodiments, the DNA encoding KinII of Wtk1 is (SEQ ID NO: 7)

```
ataggagagagctcacaaggcagagttttgttcgaagagttaagttatgg aaagagatatgcattcaagtcttctcaagaaattgatttgaagattgaag caatttcaagactgaaacacaagaacgttgtccaacttctcggaaattgg gtcgaaggaaacaaatatgttcttgcttacgagtatgtatcgggggcac
```

-continued

```
gttgcatgatattcttcacagagagggtgataagggtgtcagtggagcca ggccaggagcagctctatcatggatgcagagagtgaagattgccttaagt gcagcagaagggcttgagttcctccatcagaaggcagagcctcaggtcac ccacggtaacatcatgtccagcaagatacttctctttgacaaagataatg caaaggttggcggcgttggtatctccaatgtactggtgcgtgataacatg gttcactgtcacagttttagacaggactgtgacatggatcgtatggatgg tattcgttatcacccagatgattactatgtcgatctatatgctgctactg gacagtgtaacgcaaagagcgatgtatacgccttcggggttgtgctgctg gagcttttaaccggtcgcgaggcagttgatcatgcactacccaaaggcaa gcagagcctcgtgacatgggtatacaaccatggcgaggagaaaagcccat ggagatgggaaaacaatattatggaagacaatgtgttaacaaaaacaagt tttagtgaagatatggtgcagcgatgcgtggatccaaggcttaaaggata ttaccatcgcagtgctgttaccaagatgggtgcgatcgcgtcgctatgcg tgaattacaatccagatctccgaccaaacatgagcactgtcgtcaagggt ctgaggcaattgttgcaaaagtga.
```

In some embodiments, the isolated DNA of the invention comprises a nucleic acid sequence with at least 80% homology to SEQ ID NO: 6 and a nucleic acid sequence with at least 80% homology to SEQ ID NO: 7. In some embodiments, the isolated DNA comprises a nucleic acid sequence that encodes a protein that confers resistance to Pst. In some embodiments, the isolated DNA comprises a nucleic acid sequence with at least 95% homology to SEQ ID NO: 1. In some embodiments, the isolated DNA consists of the nucleic acid sequence of SEQ ID NO: 1.

Artificial Vectors

By another aspect there is provided an artificial vector comprising the isolated DNA of the invention. In some embodiments, the artificial vector is an expression vector. In some embodiments, the artificial vector is a plant expression vector. In some embodiments, the artificial vector is for use in expressing Wtk1. In some embodiments, the artificial vector is for use in expressing Wtk1 in a plant or cell thereof. In some embodiments, the artificial vector is for use in conferring resistance to Pst. In some embodiments, the artificial vector is for use in conferring resistance to Pst to a plant or cell thereof.

Expressing of a gene within a cell is well known to one skilled in the art. It can be carried out by, among many methods, transfection, viral infection, or direct alteration of the cell's genome. In some embodiments, the gene is in an expression vector such as plasmid or viral vector. A vector nucleic acid sequence generally contains at least an origin of replication for propagation in a cell and optionally additional elements, such as a heterologous polynucleotide sequence, expression control element (e.g., a promoter, enhancer), selectable marker (e.g., antibiotic resistance), poly-Adenine sequence.

The vector may be a DNA plasmid delivered via non-viral methods or via viral methods. The viral vector may be a retroviral vector, a herpesviral vector, an adenoviral vector, an adeno-associated viral vector, a virgaviridae viral vector, or a poxviral vector. The barley stripe mosaic virus (BSMV), the tobacco rattle virus and the cabbage leaf curl geminivirus (CbLCV) may also be used. The promoters may be active in plant cells. The promoters may be a viral promoter.

In some embodiments, the gene is operably linked to a promoter. The term "operably linked" is intended to mean that the nucleotide sequence of interest is linked to the regulatory element or elements in a manner that allows for expression of the nucleotide sequence (e.g. in an in vitro transcription/translation system or in a host cell when the vector is introduced into the host cell). In some embodiments, the promoter is operably linked to an isolated DNA of the invention. In some embodiments, the promoter is a heterologous promoter. In some embodiments, the promoter is the endogenous promoter. In some embodiments, the endogenous promoter is at least 0.5, 1, 1.5, 2, 2.5, 3, 3.5, 4, 4.5, or 5 kb upstream of the transcriptional start site of Wtk1. Each possibility represents a separate embodiment of the invention. In some embodiments, the endogenous promoter comprises SEQ ID NO: 118.

In some embodiments, the vector is introduced into the cell by standard methods including electroporation (e.g., as described in From et al., Proc. Natl. Acad. Sci. USA 82, 5824 (1985)), heat shock, infection by viral vectors, high velocity ballistic penetration by small particles with the nucleic acid either within the matrix of small beads or particles, or on the surface (Klein et al., Nature 327. 70-73 (1987)), such as biolistic use of coated particles, and needle-like particles, *Agrobacterium* Ti plasmids and/or the like.

The term "promoter" as used herein refers to a group of transcriptional control modules that are clustered around the initiation site for an RNA polymerase i.e., RNA polymerase II. Promoters are composed of discrete functional modules, each consisting of approximately 7-20 bp of DNA, and containing one or more recognition sites for transcriptional activator or repressor proteins. The promoter may extend upstream or downstream of the transcriptional start site, and may be any size ranging from a few base pairs to several kilo-bases.

In some embodiments, nucleic acid sequences are transcribed by RNA polymerase II (RNAP II and Pol II). RNAP II is an enzyme found in eukaryotic cells. It catalyzes the transcription of DNA to synthesize precursors of mRNA and most snRNA and microRNA.

In one embodiment, plant expression vectors are used. In one embodiment, the expression of a polypeptide coding sequence is driven by a number of promoters. In some embodiments, viral promoters such as the 35S RNA and 19S RNA promoters of CaMV [Brisson et al., Nature 310:511-514 (1984)], or the coat protein promoter to TMV [Takamatsu et al., EMBO J. 6:307-311 (1987)] are used. In another embodiment, plant promoters are used such as, for example, the small subunit of RUBISCO [Coruzzi et al., EMBO J. 3:1671-1680 (1984); and Brogli et al., Science 224:838-843 (1984)] or heat shock promoters, e.g., soybean hsp17.5-E or hsp17.3-B [Gurley et al., Mol. Cell. Biol. 6:559-565 (1986)]. In one embodiment, constructs are introduced into plant cells using Ti plasmid, Ri plasmid, plant viral vectors, direct DNA transformation, microinjection, electroporation and other techniques well known to the skilled artisan. See, for example, Weissbach & Weissbach [Methods for Plant Molecular Biology, Academic Press, NY, Section VIII, pp 421-463 (1988)]. Other expression systems such as insects and mammalian host cell systems, which are well known in the art, can also be used by the present invention.

In some embodiments, expression vectors containing regulatory elements from eukaryotic viruses such as retroviruses are used by the present invention. SV40 vectors include pSVT7 and pMT2. In some embodiments, vectors derived from bovine papilloma virus include pBV-1MTHA, and vectors derived from Epstein Bar virus include pHEBO, and p2O5. Other exemplary vectors include pMSG, pAV009/A+, pMTO10/A+, pMAMneo-5, baculovirus pDSVE, and any other vector allowing expression of proteins under the direction of the SV-40 early promoter, SV-40 later promoter, metallothionein promoter, murine mammary tumor virus promoter, Rous sarcoma virus promoter, polyhedrin promoter, or other promoters shown effective for expression in eukaryotic cells.

In some embodiments, recombinant viral vectors, which offer advantages such as systemic infection and targeting specificity, are used for in vivo expression. In one embodiment, systemic infection is inherent in the life cycle of, for example, the retrovirus and is the process by which a single infected cell produces many progeny virions that infect neighboring cells. In one embodiment, the result is that a large area becomes rapidly infected, most of which was not initially infected by the original viral particles. In one embodiment, viral vectors are produced that are unable to spread systemically. In one embodiment, this characteristic can be useful if the desired purpose is to introduce a specified gene into only a localized number of targeted cells.

In some embodiments, plant viral vectors are used. In some embodiments, a wild-type virus is used. In some embodiments, a deconstructed virus such as are known in the art is used. In some embodiments, *Agrobacterium* is used to introduce the vector of the invention into a virus.

Various methods can be used to introduce the expression vector of the present invention into cells. Such methods are generally described in Sambrook et al., Molecular Cloning: A Laboratory Manual, Cold Springs Harbor Laboratory, New York (1989, 1992), in Ausubel et al., Current Protocols in Molecular Biology, John Wiley and Sons, Baltimore, Md. (1989), Chang et al., Somatic Gene Therapy, CRC Press, Ann Arbor, Mich. (1995), Vega et al., Gene Targeting, CRC Press, Ann Arbor Mich. (1995), Vectors: A Survey of Molecular Cloning Vectors and Their Uses, Butterworths, Boston Mass. (1988) and Gilboa et at. [Biotechniques 4 (6): 504-512, 1986] and include, for example, stable or transient transfection, lipofection, electroporation, *agrobacterium* Ti plasmids and infection with recombinant viral vectors. In addition, see U.S. Pat. Nos. 5,464,764 and 5,487,992 for positive-negative selection methods.

It will be appreciated that other than containing the necessary elements for the transcription and translation of the inserted coding sequence (encoding the polypeptide), the expression construct of the present invention can also include sequences engineered to optimize stability, production, purification, yield, or activity of the expressed polypeptide.

In some embodiments, the artificial vector further comprises at least one nucleic acid sequence of a tandem kinase-pseudokinase (TKP)-containing gene. In some embodiments, the artificial vector further comprises at least one nucleic acid sequence of a pathogen resistance gene.

In some embodiments, the artificial vector further comprises a nucleic acid sequence with at least 95%, 90%, 85%, 80%, 75%, or 70% homology to a tandem kinase-pseudokinase (TKP)-containing gene. Each possibility represents a separate embodiment of the invention. As used herein a TKP-containing gene is a gene with an active kinase and inactive pseudokinse domain in tandem. In some embodiments, the TKP-containing gene comprises no other protein motifs. In some embodiments, the TKP-domain is homologous to the TKP domain of Wtk1. In some embodiments, the TKP-containing gene is selected from the genes provided in FIG. 13A. In some embodiments, the TKP-containing gene is selected from the genes provided in Table 13. In some embodiments, the TKP-containing gene is selected from the genes provided in Table 14. In some embodiments, the TKP-containing gene is selected from the leucine-rich-repeat receptor kinases subfamily 6B (LRR-6B), receptor-like cytoplasmic kinases subfamily 7 (RLCK_7), leucine-rick-repeat receptor kinases subfamily 3 (LFF_3), receptor-like cytoplasmic kinases subfamily 8 (RLCK_8), cell wall-associated kinase (WAK), concanavalin A-like lectin protein kinase (L-LPK), other kinases with no published family (RK_1), leucine-rich-repeat receptor kinases subfamily 12 (LRR_12) and cysteine rich kinases (LRR8B) subfamilies. In some embodiments, the TKP-containing gene is a LRR-6B, RLCK_7, LFF_3, RLCK_8, WAK, L-LPK, RK_1, RLCK_7, LRR_12 or LRR_6B subfamily gene. Each possibility represents a separate embodiment of the invention. In some embodiments, the TKP-containing gene is selected from a gene in Table 13. In some embodiments, the TKP-containing gene is selected from TraesCS1A01G061500.1, TraesCS1A01G197000.2, TraesCS1A01G432400.1, TraesCS1B01G079900.1, TraesCS1D01G033500.1, TraesCS2A01G510300.1, TraesCS2B01G538000.1, TraesCS2B01G538200.1, TraesCS2D01G123700.1, TraesCS2D01G124300.1, TraesCS2D01G511500.1, TraesCS2D01G579800.3, TraesCS3B01G579200.1, TraesCS4A01G334900.1, TraesCS4A01G335000.1, TraesCS5A01G161500.1, TraesCS5A01G241300.2, TraesCS5A01G449800.1, TraesCS5B01G005400.3, TraesCS5B01G159000.1, TraesCS5B01G239600.1, TraesCS5D01G166400.1, TraesCS5D01G241800.1, TraesCS5D01G247800.1, TraesCS5D01G459500.1, TraesCS5D01G459700.1, TraesCS5D01G537200.1, TraesCS6A01G020100.1, TraesCS6A01G036400.1, TraesCS6B01G029600.1, TraesCS6B01G050800.1, TraesCS6B01G050900.1, TraesCS6B01G051000.1, TraesCS6D01G025700.1, TraesCS6D01G042200.1, TraesCS6D01G042300.1, TraesCS7B01G048900.1, TraesCS7D01G147900.1, HORVU1Hr1GO11660.17, HORVU1Hr1G051220.15, HORVU5Hr1G050470.1, HORVU5Hr1G107460.3, HORVU6Hr1G003940.7, HORVU6Hr1G025940.2, HORVU7Hr1G001450.11, HORVU7Hr1G001600.12, Sc1Loc00250465.1, Sc5Loc01920045.3, Sc2Loc00020948.6, Os01t0310500-01, Os07t0493200-01, Os07t0493800-00, Os07t0494300-00, Os10t0141200-00, Os10t0143866-00, Os11t0173432-00, Os11t0445300-01, Os11t0553500-00, Os11t0556400-00, AQK57443.1, AQK57450.1, AQK57451.1, AQK57454.1, AQK58522.1, AQK90211.1, AQK92446.1, ONM26931.1, AT2G32800.1, Pp1s31_26V6.1, PGSC0003DMP400002294, BnaA07g14690D, BnaA09g41440D, BnaC04g38500D, BnaA03g15120D, BnaA02g06510D, Potri.017G055000, Potri.001G315000, SOBIC.010G171600.1.P, SOBIC.005G096400.1.P, SOBIC.008G022300.2.P, SOBIC.001G353800.1.P, SOBIC.008G148200.2.P, SOBIC.010G028950.1.P, SOBIC.005G154100.1.P, SOBIC.009G246800.1.P, SOBIC.005G155100.1.P, SOBIC.005G154800.1.P, SOBIC.005G060700.2.P, SOBIC.001G354100.2.P, WTK1, MLOC, and RPG1. In some embodiments, the TKP-containing gene is selected from TraesCS1A01GO61500.1, TraesCS1A01G197000.2, TraesCS1A01G432400.1, TraesCS1B01GO79900.1, TraesCS1D01GO33500.1, TraesCS2A01G510300.1, TraesCS2B01G538000.1, TraesCS2B01G538200.1, TraesCS2D01G123700.1, TraesCS2D01G124300.1, TraesCS2D01G511500.1, TraesCS2D01G579800.3, TraesCS3B01G579200.1, TraesCS4A01G334900.1, TraesCS4A01G335000.1, TraesCS5A01G161500.1, TraesCS5A01G241300.2, TraesCS5A01G449800.1, TraesCS5B01G005400.3, TraesCS5B01G159000.1, TraesCS5B01G239600.1, TraesCS5D01G166400.1, TraesCS5D01G241800.1, TraesCS5D01G247800.1, TraesCS5D01G459500.1, TraesCS5D01G459700.1, TraesCS5D01G537200.1, TraesCS6A01GO20100.1, TraesCS6A01GO36400.1, TraesCS6B01GO29600.1, TraesCS6B01GO50800.1, TraesCS6B01G050900.1, TraesCS6B01GO51000.1, TraesCS6D01GO25700.1, TraesCS6D01GO42200.1, TraesCS6D01GO42300.1, TraesCS7B01GO48900.1, TraesCS7D01G147900.1, HORVU1Hr1G011660.17, HORVU1Hr1G051220.15, HORVU5Hr1G050470.1, HORVU5Hr1G107460.3, HORVU6Hr1G003940.7, HORVU6Hr1G025940.2, HORVU7Hr1G001450.11, HORVU7Hr1G001600.12, Sc1Loc00250465.1, Sc5Loc01920045.3, Sc2Loc00020948.6, Os01t0310500-01, Os07t0493200-01, Os07t0493800-00, Os07t0494300-00, Os10t0141200-00, Os10t0143866-00, Os11t0173432-00, Os11t0445300-01, Os11t0553500-00, Os11t0556400-00, AQK57443.1, AQK57450.1, AQK57451.1, AQK57454.1, AQK58522.1, AQK90211.1, AQK92446.1, ONM26931.1, AT2G32800.1, Pp1s31_26V6.1, PGSC0003DMP400002294, BnaA07g14690D, BnaA09g41440D, BnaC04g38500D, BnaA03g15120D, BnaA02g06510D, Potri.017G055000, Potri.001G315000, SOBIC.010G171600.1.P, SOBIC.005G096400.1.P, SOBIC.008G022300.2.P, SOBIC.001G353800.1.P, SOBIC.008G148200.2.P, SOBIC.010G028950.1.P, SOBIC.005G154100.1.P, SOBIC.009G246800.1.P, SOBIC.005G155100.1.P, SOBIC.005G154800.1.P, SOBIC.005G060700.2.P, SOBIC.001G354100.2.P and MLOC. In some embodiments, the amino acid sequence encoded by a tandem kinase-pseudokinase (TKP)-containing gene is selected from SEQ ID NOs: 123-213. In some embodiments, the amino acid sequence encoded by a tandem kinase-pseudokinase (TKP)-containing gene is selected from SEQ ID NOs: 124-213. In some embodiments, the amino acid sequence encoded by a tandem kinase-pseudokinase (TKP)-containing gene is selected from SEQ ID NOs: 123-214. In some embodiments, the amino acid sequence encoded by a tandem kinase-pseudokinase (TKP)-containing gene is selected from SEQ ID NOs: 124-214.

In some embodiments, the artificial vector further comprises a nucleic acid sequence with at least 95%, 90%, 85%, 80%, 75%, or 70% homology to a pathogen-resistance gene. As used herein, the term "pathogen-resistance gene" refers to a gene that provides a plant or plant cell with resistance to a pathogen. In some embodiments, the pathogen is a bacterial pathogen. In some embodiments, pathogen is Pst. Pathogen-resistance genes are well known in the art, and include, but are not limited to Yr18, Yr5, Yr36, Yr46, Yr17, Yr29, Lr10, Lr13, Yr58, Sr13 and Sr 21. Yr18 is also known as Lr34 and Sr57. Yr29 is also known as Lr46. Yr46 is also known as Lr67. Yr18 is also known as Lr34 and Sr57. In some embodiments, the pathogen resistance gene is selected from Yr18, Yr5, Yr36, Yr46, Yr17, Yr29, Lr10, Lr13, Yr58, Sr13 and Sr 21. In some embodiments, the pathogen resistance gene is selected from Yr18, Yr5, Yr36, and Yr46. In some embodiments, the pathogen resistance gene is selected from Yr18, Yr5, and Yr36. In some embodiments, the pathogen resistance gene is selected from Yr18, and Yr5. In some embodiments, the pathogen resistance gene is Yr5.

In some embodiments, the artificial vector further comprises a nucleic acid sequence with at least 95%, 90%, 85%, 80%, 75%, or 70% homology to a Yr36 gene. Each possibility represents a separate embodiment of the invention. In some embodiments, Yr36 comprises any one of the nucleic acid sequences denoted by SEQ ID NOs: 8-13. In so embodiments, the artificial vector comprises a Yr36 gene. In some embodiments, the artificial vector comprises any one of SEQ ID NOs: 8-13. In some embodiments, the Yr36 gene is operably linked to a plant promoter. In some embodiments, the artificial vector comprises a nucleic acid sequence that encodes for a Yr36 protein. In some embodiments, the Yr36 protein has the amino acid sequence denoted by any one of SEQ ID NO: 14-18.

In some embodiments, the artificial vector further comprises a nucleic acid sequence with at least 95%, 90%, 85%, 80%, 75%, or 70% homology to a Yr5 gene. Each possibility represents a separate embodiment of the invention. In some embodiments, the artificial vector further comprises a Yr5 gene. In some embodiments, the Yr5 gene is operably linked to a plant promoter. In some embodiments, the artificial vector further comprises a nucleic acid sequence that encodes for a Yr5 protein. In some embodiments, the Yr5 genes encodes a protein comprising the sequence

```
                                          (SEQ ID NO: 120)
KEYFNEFAWVTVSQKFKGIDLLNDILKQITGASYESSKATDQIQENEIGK
KIHDFLLQRRYLLVLDDVWEADTWEQINRAAKVSPDTNNGSRVLLTTRKK
DVAHHIQMPTYVCDLKLMDEEKSWELFKSKALPSYRTYMICNPDKF.
```

In some embodiments, the sequence of Yr5 comprises a sequence selected from the sequences provided in Accession numbers JQ318576.1, JQ318577.1, JQ318578.1, JQ318579.1, JQ318580.1, JQ318581.1, JQ318582.1, JQ318583.1, JQ318584.1, JQ318585.1, JQ318586.1, JQ318587.1, and JQ318588.1.

In some embodiments, the artificial vector further comprises a nucleic acid sequence with at least 95%, 90%, 85%, 80%, 75%, or 70% homology to a Yr18 gene. Each possibility represents a separate embodiment of the invention. In so embodiments, the artificial vector further comprises a Yr18 gene. In some embodiments, the Yr18 gene is operably linked to a plant promoter. In some embodiments, the artificial vector further comprises a nucleic acid sequence that encodes for a Yr18 protein. In some embodiments, the Yr18 gene encodes a protein with at least 95%, 90%, 85%, 80%, 75%, or 70% homology to the sequence

```
                                          (SEQ ID NO: 121)
MDIALASAAATWLINKLLDRLSDYAIKKLLGSEGLDAEASSLRDALRRAT
LVLGAVPAGAAAGVRIGNDQLLPQIDLVQRLATDLARHLDELEYYDVKKK
VKKNQKSSNPLSKMNLPLTQAGQSKPKYNRTDIKQIRDTVGYLHSICDDV
HKALLLDKLDAIKQAAQDASTDKRETVDNFTENPRNKVFPREEMKDIIEL
INSAASSDQELLVVPIVGAGGVGKTTLARLVYHDPEVKDKFDIMLWIYVS
ANFDEVKLTQGILEQIPECEFKSAKNLTVLQRGINKYLTKRFLLVLDDMW
EESEGRWDKLLAPLRSAQAKGNVLLVTTRKLSVARITSNTEAHIDLDGMK
KDDFWLFFKRCIFGDENYQGQRKLQNIAKKIATRLNGNPLAAKSVGTLLR
RNINEDYWTRILDSNEWKLQESIDDIIPALKLSYNQLPYRLQLLFSYCAM
FPKGYNFDKGQLICTWIALGFVMNERKKLEDEGSDCFDDLVDRSFFQKYG
VSQYYTVHDLMHDVAQEVSINKCLIIDGSDLRTVPSSICHLSIWTEPVYN
EQSIERNDNFEEKLDAVQDNVLGSLECLILAGVYDENYSAKFVKTLERVR
YVRMLQLTAMPFNSDILLSSIKKLIHLRYLELRCTSDKPKSLPEAICKLY
HLQVLDVQHWSGLNDLPKDMSNLVNLRHLFVPGSGSLHSKISRVGELKFL
QELKEFQVQEADGFEISQLGNINEIRGSLSILGLETVKKKGDATRARLKD
KKHLRTLSLTWGSASGSTTTVQKEVMEGLKPHENLSHLLVYNYSGATPSW
LLGDSFSLGNLESLHLQDCAAVKILPPFEEMPFLKKLSLVCMPCLKSIRI
DFNSADEEDELELSEIEISKCLALTSIRLHSCKALTMLSINDCEALGSLE
GLSFSEKLKQCVVQGCPKLPSGFIAN.
```

Each possibility represents a separate embodiment of the invention. In some embodiments, the Yr18 gene comprises a nucleotide sequence with at least 95%, 90%, 85%, 80%, 75%, or 70% homology to the sequence provided in accession number XM_015795636.1. In some embodiments, the sequence of Yr5 comprises a sequence selected from the sequences provided in Accession numbers EU423905.1, EF489022.1, and EU423903.1.

In some embodiments, the artificial vector further comprises a nucleic acid sequence with at least 95%, 90%, 85%, 80%, 75%, or 70% homology to a Yr46 gene. Each possibility represents a separate embodiment of the invention. In so embodiments, the artificial vector further comprises a Yr46 gene. In some embodiments, Yr46 is the Lr67 gene. In some embodiments, the Yr46 gene is operably linked to a plant promoter. In some embodiments, the artificial vector further comprises a nucleic acid sequence that encodes for a Yr46 protein. In some embodiments, Yr46 comprises or consists of the sequence

```
                                          (SEQ ID NO: 122)
ATGCCGGGCGGGGGGTTCGCCGTGTCGGCGCCGTCCGGCGTGGAGTTCGA
GGCCAAGATCACGCCCATCGTCATCATCTCCTGCATCATGGCGGCCACCG
GCGGCCTCATGTTCGGCTACGACGTCGGCATCTCAGGCGGAGTGACATCG
ATGGACGATTTCCTGCGTGAGTTCTTCCCGGCGGTGCTGCGCCGGAAGAA
CCAGGACAAGGAGAGCAACTACTGCAAGTACGACAACCAGGGCCTGCAGC
TCTTCACCTCGTCGCTCTACCTCGCCGGCCTCACCGCCACCTTCTTCGCC
TCCTACACCACCCGCCGCCTCGGACGCCGCCTCACCATGCTCATCGCCGG
CGTCTTCTTCATCATCGGCGTCATCTTCAACGGGGCCGCCCAGAACCTCG
CCATGCTCATCATCGGCAGGATCCTGCTTCGTTGCGGCGTCGGCTTCGCC
AACCAGGCCGTTCCCCTGTTCCTGTCGGAGATCGCGCCGACGAGGATCCG
CGGCGGGCTCAACATCCTGTTCCAGCTGAACGTGACCATCGGCATCCTGT
TCGCGAACCTGGTGAACTACGGCACGAGCAAGATCCACCCGTGGGGCTGG
CGGCTGTCGCTGTCGCTGGCCGGCATCCCGGCGGCGATGCTCACCCTGGG
CGCGCTCTTCGTCACCGACACCCCCAACAGCCTCATCGAGCGCGGCCACC
TGGAGGAGGGCAAGGCGGTGCTCAAGCGGATCCGCGGCACCGACAACGTG
GAGCCGGAGTTCAACGAGATCGTGGAGGCGAGCCGCATCGCGCAGGAGGT
GAAGCACCCGTTCCGGAACCTGCTCCAGCGCCGGAACCGCCCGCAGCTGG
TCATCGCCGTGCTGCTCCAGATCTTCCAGCAGTTCACGGGGATCAACGCC
ATCATGTTCTACGCCCCCGTGCTGTTCAACACGCTCGGGTTCAAGAGCGA
CGCGTCGCTCTACTCGGCGGTGATCACGGGCGCCGTCAACGTGCTGGCCA
CGCTGGTGTCGGTGTACGCCGTGGACCGCGCCGGGCGGCGCGCGCTGCTG
```

```
-continued
CTGGAGGCTGGCGTGCAGATGTTCCTGTCGCAGGTGGTGATCGCCGTGGT

GCTGGGCATCAAGGTGACGGACAAGTCGGACAACCTGGGCCACGGGTGGG

CCATCCTGTTGGTGGTCATGGTGTGCACCTACGTGGCCTCCTTCGCCTGG

TCCTGGGGCCCGCTGGGGTGGCTCATCCCCAGCGAGACGTTCCCGCTGGA

GACGCGGTCGGCGGGGCAGAGCGTGACGGTGTGCGTCAACCTGCTCTTCA

CCTTCCTCATCGCGCAGGCCTTCCTCTCCATGCTCTGCCACCTCAAGTTC

GCCATCTTCATCTTCTTCTCGGCCTGGGTGCTCGTCATGTCCGTCTTCGT

GCTCTTCTTCCTCCCGGAGACCAAGAACGTGCCCATCGAGGAGATGACCG

ACAAGGTGTGGAAGCAGCACTGGTTCTGGAAGAGATTCATGGACGACGAC

GACCACCACCACAACATCGCCAACGGCAAGAACGCCACCGTCTGA.
```

In some embodiments, the artificial vectors of the invention comprise at least one promoter for transcription in a plant cell. In some embodiments, the artificial vectors of the invention comprise at least one promoter for expression in a plant cell. In some embodiments, the plant is a grain/cereal plant. In some embodiments, the grain/cereal plant is wheat. In some embodiments, the grain plant is selected from barley, rye, triticale, oat, triticale, spelt and wheat. In some embodiments, the grain plant is selected from barley, rye, rice, maize, triticale, oat, triticale, spelt and wheat. In some embodiments, the at least one promoter is operably linked to an isolated DNA of the invention. In some embodiments, the at least one promoter is operably linked to a Yr5 gene. In some embodiments, the artificial vector comprises a DNA of the invention and the Yr5 gene. In some embodiments, the DNA of the invention and the Yr5 gene are operably linked to the same promoter. In some embodiments, the DNA of the invention and the Yr5 gene are operably linked to different promoters.

As used herein, the term "wheat" refers to a plant of the genus *Triticum*. Wheat can be used for the production of grain such as is used for bread, cereal or pasta for non-limiting examples. In some embodiments, wheat is bread wheat or durum wheat. In some embodiments, wheat comprises spelt. In some embodiments, wheat is *Triticum turgidum*.

Transgenic Plants and Cells Thereof

By another aspect there is provided a transgenic plant cell, comprising an isolated DNA of the invention or artificial vector of the invention. As used herein, a "transgenic cell" refers to a cell that has undergone human manipulation on the genomic or gene level. In some embodiments, the transgenic cell has had exogenous DNA introduced into it. In some embodiments, a transgenic cell comprises a cell that has an artificial vector introduced into it. In some embodiments, a transgenic cell is a cell which has undergone genome mutation or modification. In some embodiments, a transgenic cell is a cell that has undergone CRISPR genome editing. In some embodiments, a transgenic cell is a cell that has undergone targeted mutation of at least one base pair of its genome. In some embodiments, the DNA or vector is stably integrated into the cell. In some embodiments, the transgenic cell expresses a DNA of the invention. In some embodiments, the transgenic cell expresses a vector of the invention. In some embodiments, the transgenic cell expresses a protein of the invention. In some embodiments, the transgenic cell, is a cell that comprises a wtk1 non-functional allele and/or pseudogene that has been mutated or modified into a functional WTK1 gene. In some embodiments, the wtk1 non-functional allele and/or pseudogene has been modified to comprise SEQ ID NO: 1. In some embodiments, the wtk1 non-functional allele and/or pseudogene has been modified to comprise SEQ ID NO: 3. In some embodiments, a wtk1 non-functional allele has been modified to encode a protein comprising the amino acid sequence provided in SEQ ID NO:2. In some embodiments, a wtk1 non-functional allele has been modified to encode a protein comprising an amino acid sequence with at least 99%, 95%, 90%, 85%, 80%, 75%, or 70% homology or identity to SEQ ID NO:2, and which confers resistance to Pst. In some embodiments, CRISPR technology is used to modify a wtk1 non-functional allele.

In some embodiments, the plant is a grain/cereal plant. In some embodiments, the plant is any plant that without addition of the vectors or nucleic acids of the invention can be infected by Pst. In some embodiments, the plant is selected from barley, rye, triticale, oat, and wheat. In some embodiments, the plant is selected from barley, rye, triticale, oat, wheat, rice and maize. In some embodiments, the plant is wheat. In some embodiments, the transgenic plant cell is resistant to Pst. In some embodiments, the transgenic plant cell cannot be infected by Pst. In some embodiments, Pst does not grow on the transgenic plant cell. In some embodiments, Pst grows poorly on the transgenic plant cell. In some embodiments, Pst grows worse on the transgenic plant cell than on a plant cell that does not comprise a vector or nucleic acid molecule of the invention.

By another aspect there is provided a transgenic plant, or any portion, seed, tissue or organ thereof, comprising at least one transgenic plant cell of the invention. In some embodiments, the transgenic plant or portion thereof consists of transgenic plant cells of the invention. In some embodiments, the plant or portion thereof comprises at least 20%, 25%, 30%, 35%, 40%, 45%, 50%, 55%, 60%, 65%, 70%, 75%, 80%, 85%, 90%, 95%, 97%, or 99% transgenic cells of the invention. Each possibility represents a separate embodiment of the invention.

In some embodiments, the plant is a grain/cereal plant. In some embodiments, the plant is any plant that without addition of the vectors or nucleic acids of the invention can be infected by Pst. In some embodiments, the plant is selected from barley, rye, triticale, oat and wheat. In some embodiments, the plant is selected from barley, rye, triticale, oat, wheat, rice and maize. In some embodiments, the plant is wheat. In some embodiments, the transgenic plant is resistant to Pst. In some embodiments, the transgenic plant cannot be infected by Pst. In some embodiments, Pst does not grow on the transgenic plant. In some embodiments, Pst grows poorly on the transgenic plant. In some embodiments, Pst grows worse on the transgenic plant than on a plant that does not comprise a transgenic cell of the invention.

Isolated Proteins

By another aspect, there is provided an isolated protein encoded by an isolated DNA of the invention. In some embodiments, the isolated protein comprises an amino acid sequence with at least 80% homology to SEQ ID NO:2, and wherein the isolate protein confers resistance to Pst. In some embodiments, the isolated protein comprises the amino acid sequence of SEQ ID NO: 2. In some embodiments the isolated protein consists SEQ ID NO: 2. In some embodiments, the isolated protein is WTK1. In some embodiments, the isolated protein comprises or consists of an analog to WTK1 or SEQ ID NO: 2. In some embodiments, the isolated protein comprises or consists of a fragment to WTK1 or SEQ ID NO: 2. In some embodiments, the isolated protein comprises or consists of a derivative of WTK1 or SEQ ID NO: 2. In all such embodiments, it will be understood that the protein will retain the ability to confer resistance to Pst to a cell or plant to which it is introduced.

The term "derivative" as used herein, refers to any polypeptide that is based off the polypeptide of the invention and still confers resistance to Pst. A derivative is not merely a fragment of the polypeptide, nor does it have amino acids replaced or removed (an analog), rather it may have additional modification made to the polypeptide, such as post-translational modification. Further, a derivative may be a derivative of a fragment of the polypeptide of the invention, however, in such a case the fragment must comprise at least 100 consecutive amino acids of the polypeptide of the invention.

In some embodiments, the isolated protein of the invention comprises KinI and KinII. In some embodiments, KinI and KinII are separated by a spacer. In some embodiments, the spacer is at least 1, 3, 5, 10, 15, 20, or 25 amino acids. Each possibility represents a separate embodiment of the invention. In some embodiments, the isolated protein comprises a functional analog or derivative of KinI and/or KinII. It will be understood that this functionality is determined by the ability to confer resistance to Pst.

Differentially Binding Molecules

By another aspect, there is provided a nucleic acid molecule capable of binding differentially to a functional Wtk1 nucleic acid molecule and a non-functional wtk1 nucleic acid molecule, wherein a functional Wtk1 confers resistance to Stripe Rust (Pst). In some embodiments, the sequence of the functional Wtk1 is selected from SEQ ID NO: 1 and SEQ ID NO: 3. In some embodiments, the sequence of the functional Wtk1 comprises two kilobases upstream and/or downstream of the Wtk1 genomic DNA provided in SEQ ID NO: 3). In some embodiments, the nucleic acid molecule is an isolated nucleic acid molecule.

As used herein, a "non-functional allele" and "wtk1" are used interchangeably and refer to an allele with high identity to Wtk1, but which lacks the ability to make a functional protein that provides resistance to Pst. In some embodiments, the non-functional allele comprises an insertion, deletion and/or mutation in the coding region. In some embodiments, the insertion, deletion and/or mutation results in a stop codon being introduced and low or no production of full-length protein. In some embodiments, a non-functional allele comprises a point-mutation in KinI and/or KinII. In some embodiments, a non-functional allele is a pseudogene of Wtk1

In some embodiments, the sequence of the non-functional wtk1 is from *T. dicoccoides* accession Zavitan. In some embodiments, the sequence of the non-functional wtk1 comprises (SEQ ID NO: 111)
ATGGATTACCAAGGAAACAATCTTAATGATTTCTTTCAAACTAATGGGCA

TTTGGTACTTAAAAGTGTGGACAACAACTATAAACTGCGATCCTTCACTG

AAAAGGAGATAAAGCACATTACGAAAAGATATAGCACTTTGCTTGGTAGT

GGCTCGTTCGGTGATGTCTACAAAGGAAGATTAGATGATCAACGCCCAGT

CGCAGTAAAGAGATACAAAAATGGAACCAATAAAGAGGAGTTCGCCAAGG

AGGTGATAGTGCACTCCCAGATAAACCACAAGAATGTTGTCAAATTGTTA

GGATGCTGCACAGAGGAAAATGCTCTTATGATTGTTATGGAGTTTATCTG

TAATGGAAACCTCTACAACATCCTTCACTGTGGCAATGCTGATGGTCCTA

-continued
TCCCTTTTCATTTGCACAAACGTTTGGACATCGCCATTGAGTCAGCTGAA

GCGCTATCATGTATGCATTCAATGTACAGTCCTGTCCTTCATGGTGACAT

TAAACCTGCCAATATACTGTTGGATGGAAAGTACTTGCCAAAGCTATCTG

ATTTTGGAATAGCAAGATTGCTTTCTACTGACGAGGCCCAGCGTACCAAA

ACTGTTATTGGTTGCATAGGTTATGTGGACCCTTTGTTTTGTCAGAGTGG

GATTCTCACTACAAAGAGTGATGTATACAGTTTTGGAGTTGTTCTGTTGG

AAATGATCACCCGAAAGAAAGCGACGGACGGGGCTACTAGTCTTACTCAA

TGTTTCTCTGAGGCCCTGCGTAGAGGGAAGAAGGTGAGACAACTGTTTGA

TGTGGAAATTGCCAATGACAAGAACATTAAGTTGATCGAAGATATTGCAA

AGCTAGCAGCTACATGCTTGAGACTGGATGATAAAATGCGTCCGACAATT

GTTGAGGTAGCAGATAGACTTAGGAGGATTAGAAAAGCTCTCCCGCAGCG

CAAGAGTGAAAGCTCTACAGGCATCAACAATGGGCTCATAAGAAGAGGAA

AGGCAGAGGATGTACCAACTATTTCCCTTGATGAAATGAAGAAAATAACA

AGAAACTTCAGTAATGGTGCTTTAATAGGAGAGAGCTCACAAGGCAGAGT

TTTCTTCAAAGTGTTAAAATATGGACCGGAATATGCATTCAAGTCTTCTC

AAGAAATTGATTTGAAGATTGAAGCGATTTCAAGACTGAAACACGAGAAC

GTTGTCCAACTTCTCGGGTATTGGGTCGAAGGAGACAAATATGTTCTTGC

TTACGAGTATGCATCGGGGGGCACTTTGCATGATATTCTTCACAGCGAGG

AAATCCAGGCCGTCGGCAAATCGGTGCCAAGTCAGGAACAGTTCTATCAT

GGATGCAGAGAGTGAAGATTGCCTTAAGTGCAGCAGAAGGGCTTGAGTTC

CTCCATCATAAGGCAGAGCCTCAGGTCACCCACGGTAACATCATGTCCAG

CAAGATACTTCTCTTTGACAACGATATCGCAAAGGTTGGCGACGTCGGCA

TATCCAATGTGCTGGTCAGTGATGACATGGATAGCTGTCATAGTTTTAGA

TGGGACCTTGACACGGATCGTATGAATGATCATTATTATCACCAAGATGA

TTACCATGTCGATGTATATGCTGCTACTGGACAGTGCAACACAAAGAGTG

ATGTATACGCCTTCGGGGTTGTGCTGCTGAAACTTTTAACCGGTCGTAAG

GCAGTTGATCATACACTACCCCGCGGCAGGCAGAGCCTCGTGACATGGGT

ATGCACCCTTGGCAAGAAGAACCTATGCAACCATTGTGACGAGCATACAA

TTTTATGGAAGACAATGTGTTACCAAAAACAAGTTTTAGTGAAGATAAGG

TGCAGCGATGCATGGATCCAAGGCTTGAAGGAGATTACCCTCGCAATGCT

GCTACCAAGATGGGTGCGATCGCGGCGCTATGTGTGAATTACAATCCAGA

TCTCCGACCAAACATGAGCACTGTCGTCAAGGGTCTGAGACAATTGCTAC

ACAGCGA.

In some embodiments, the sequence of the non-functional wtk1 consists of SEQ ID NO: 111).

In some embodiments, the sequence of the non-functional wtk1 is from *T. aestivum* cultivar name (cv.) Chinese spring. In some embodiments, the sequence of the non-functional wtk1 comprises (SEQ ID NO: 112)
ATGGATTACCAAGGAAACAATCTTAATGATTTCTTTCAAACTAATGGGCA

TTTGGTACTTAAAAGTGTGGACAACAACTATAAACTGCGATCCTTCACCG

-continued

```
AAAAGGAGATAAAGCACATTACGAAAAGATATAGCACTTTGCTTGGTAGT
GGCTCGTTCGGTGATGTCTACAAAGGAAGATTAGATGATCAACGCCCAGT
CGCAGTAAAGAGATACAAAAATGGAACCAATAAAGAGGAGTTCGCCAAGG
AGGTGATAGTGCACTCCCAGATAAACCACAAGAATGTTGTCAAATTGTTA
GGATGCTGCATAGAGGAAAATGCTATTATGATTGTTATGGAGTTTATCTG
TAATGGAAACCTCTACAACATCCTTCACTGTGGCAATGCTGATGGTCCTA
TCCCTTTTCATTTGCACAAACGTTTGGACATCGCCATTGAGTCAGCTGAA
GCGCTATCATGTATGCATTCAATGTACAGTCCTGTCCTTCATGGTGACAT
TAAACCTGCCAATATACTGTTGGATGGAAAGTACTTGCCAAAGCTATCTG
ATTTTGGAATAGCAAGATTGCTTTCTACTGACGAGGCCCAGCGTACCAAA
ACTGTTATTGGTTGCATAGGTTATGTGGACCCTTTGTTTTGTCAGAGTGG
GATTCTCACTACAAAGAGTGATGTATACAGTTTTGGAGTTGTTCTGTTGG
AAATGATCACCCGAAAGAAAGCGACGGACGGGGCTACTAGTCTTACTCAA
TGTTTCTCTGAGGCCCTGGGTAGAGGGAAGAAGGTGAGACAACTGTTTGA
TGTGGAAATTGCCAATGACAAGAACATTAAGTTGATCGAAGATATTGCAA
AGCTAGCAGCTACATGCTTGAGACTGGATGATAAAATGCGTCCGACAATT
GTTGAGGTAGCAGATAGACTTAGGAGGATTAGAAAAGCTCTCCCCCAGCG
CAAGAGTGAAAGCTCTACAGGCATCAACAATGGGCTCATAAGAAGAGGAA
AGGCAGAGGATGTACCAACTATTTCCCTTGATGAAATGAAGAAAATAACA
AGAAACTTTAGTAATGGTGCTTTAATAGGAGAGAGCTCACAAGGCAGAGT
TTTCTTCAAAGTGTTAAAATATGGACCGGAATATGCATTCAAGTCTTCTC
AAGAAATTGATTTGAAGATTGAAGCGATTTCAAGACTGAAACACGAGAAC
GTTGTCCAACTTCTCGGGTATTGGGTCGAAGGAGACAAATATGTTCTTGC
TTACGAGTATGCATCGGGGGCACTTTGCATGATATTCTTCACAGCGAGG
AAATCCAGGCCGTCGGCAAATCGGTGCCAAGTCAGGAACAATTCTATCAT
GGATGCAGAGAGTGAAGATTGCCTTAAGTGCAGCAGAAGGGCTTGAGTTC
CTCCATCATAAGGCAGAGCCTCAGGTCACCCACGGTAACATCATGTCCAG
CAAGATACTTCTCTTTGACAACGATATCGCAAAGGTTGGCGACGTCGGCA
TATCCAATGTGCTGGTCAGTGATGACATGGATAGCTGTCATAGTTTTAGA
TGGGACCTTGACACGGATCGTATGAATGATCATTGTTATCACCAAGATGA
TTACCATGTCGATGTATATGCTGCTACTGGACAGTGCAACACAAAGAGTG
ATGTATACGCCTTCGGGGTTGTGCTGCTGAAACTTTTAACCGGTCGTAAG
GCAGTTGATCATACACTACCCCGCGGCAGGCAGAGCCTCGTGACATGGGT
ATGCACCCTTGGCAAGAAGAACCTATGCAACCATTGTGACGAGCATACAA
TTTTATGTTAGACAATGTGTTAACAAAAACAAGTTTTAGTGAAGATAAGG
TGCAGCGATGCATGGATCCGAGGCTTGAAGGAGATTACCCTCGCAATGCT
GCTACCAAGATGGGTGCGATCGCGGCGCTATGTGTGAATTACAATCCAGA
TCTCCGACCAAACATGAGCACTGTCGTCAAGGGTCTGAGACAATTGCTAC
ACAGCGA.
```

In some embodiments, the sequence of the non-functional wtk1 consists of SEQ ID NO: 112).

In some embodiments, the sequence of the non-functional wtk1 is from *T. durum* cv. Kronos. In some embodiments, the sequence of the non-functional wtk1 comprises (SEQ ID NO: 113)
```
CCAGTCGCAGATAAGAGATACAAAAATGGAACCAATAAAGAGGAATTCGC
CAAGGAGGTGATAGTGCATTCCCAGATAAACAACAAGAATGTTGTCAGAT
TGTTAGGCTGCTGCACCGAGGAAAATGCCCTAATGATTGTTATGGAGTTT
ATCTGTAATGGAAACCTCTATAGCATCCTTCACTGTGGCAATGTTGATGG
TCCTATCCCCTTCCCTTTGTACAAACGTTTGGACATCGCCATTGAGTTAG
CTGAAGCACTATCATGTATGCATTCGATGTACAGTCCTGTCCTTCATGGT
GACATTAAACCTGCCAATATACTGTTGGATGAAAAGTACTTGCCAAAGCT
ATCTGATTTTGGAATAGCAAGATTCCTTTCTACTTACGAGGCCCAGCGTA
CCGAAACTGTTATTGGTTGCATAGGTTATGTGGACCCTTTGTTTTGTCAG
AGTGGGGTTCTGACTACAAAGAGTGATGTATACAGTTTTGGAGTTGTTCT
GTTGGAAATGATCACCCGAAAGAAAGCGACGGAGGGGGCTACTAGTCTTA
CTCAATGTTTCGTCGAAGCCCTGGGAAGAGGGAAGAAGGTGAGACAACTG
TTTGATGTGGAAATTGCCAATGACAGGAAGAAGATGAAATTGATCGAAGA
TATTGCGAAACTAGCAGCTACATGCTTGAGACTGGATGATAAAATGCGCC
GACAATGGTTGAGGTAGCAGGCAGACTTAGGATGATTAGAAAAGCTCTC
CCCCAGCACAAGGGTGAAAGCTCTACAGACATCAACAATGGCTCATAAG
AAGAGGAAAGGCAGAGGTTGTACCAACTATTTCCCTTGATGAAATGAAGA
AAATAACAAGGAACTTCAGTAATGGTGCTCTAATAGGAGAGAGCTCACAA
GGCTGAGTTTTCTTCAAAGTGTTAAAATATGGTCTGGAAACTGCATTAGG
ATCATGGCGGTGTGTATCGTATGATGATTGAAACAATTTCAAGACTGAAA
CATGAGAACGTGTCCAATTTCTCGGACATTGGGTCGAAGGAGACGAATAT
GTTCTGGCATATGAGTATATATCAGGTGGCACCTTGCATGATATCCTTCA
CAGCAAGGGTAAAATGGGTATTAATGGTGCCAAATCACGAGCAGCTCTAT
CATGGATGCAGAGAGTGAAGATTGCCTTAAGTGCAGCTGAAGGGCTTGAG
TTCCTCCATCATAAGGCAGAGCGTCAGGTCACCCACGGTAACATCATGTC
CAGCAAGATACTTCTCTTTGACAACGACATCGCAAAGATTGGCGACGTTG
GTATCTCCAATGTACTGGTCAGTGATGACATGCGTAGCTGCCATAGTTTT
AGACGGGACTGTGACATGAATCGTATGGATGGTCGTGGTTTTCGCCCAGA
TCATTACCATGTCGATCTATATGCTGCTACTGGACAGTGCAACACAAAGA
GCGATGTATACTTCTTCGGGGTTGTGCTGCTGGAGCTTTTAAGCGGTCGC
AAGGCAGTTGATCATACACTACCCCAGGGCAGGCAGAGCCTCGTGACATG
GGTATGCACCCTTGGCGAGAAGGGCCTATGCACCCATTGTGACGAGCATA
CAATTTTATGGAAGACAATGTGTTAACAAAAACAAGTTTTAGTGAAGATA
AGGTGCAGCGATGCATGGATCCAAGGCTTGAAGGAGATTACCCTCGCAAT
GCTGCTACCAAGATGGGTGCGATCGCAGCGCTATGTGTGCATTACAATCC
AGATCTCCGACCAAACATGAGCACTGTCGTCAAGGGTCTGAGACAATTGC
TGCAAATGTGA.
```

In some embodiments, the sequence of the non-functional wtk1 consists of SEQ ID NO: 113).

In some embodiments, the sequence of the non-functional wtk1 is from *T. aestivum* cv. Cadenza_1b. In some embodiments, the sequence of the non-functional wtk1 comprises (SEQ ID NO: 114)
ATGGATTACCAAGGAAACAATCTTAGTGATTTCTTTCAAGCTAATGGGC

ATTTGGTACTTAAAAGAGTGGACAACAACTATAAACTGCGGTCCTTCAC

TGAAAAGGAGATAGAGCACATTACAGACAGATATAGCACTTCGCTTGGT

AGTGGCTCGTTCGGTGATGTCTACAAAGGAAGATTAGACGATCAACGTC

CAGTCGCAGTAAAGAGGTACAAAAATGGAACCAAGAAAGAGGAGTTCGC

CAAGGAGGTGATAGTGCATTCCCAGATAAACCACAAGAATGTTGTCAGA

TTGTTAGGCTGCTGCACGGAGGAAAATGCCCTTATGATTGTTATGGAGT

TTGTCTGTAATGGAAACCTCTACAACATCCTTCACTGTAGCAATGCTGA

TGGTCCTATACTCTTCCCTTTGGACAAACGTTTGGACATCGCTATTGAA

TCAGCTGAAGCACTATCATGCATGCATTCAATGTACAGTCCTGTCCTTC

ATGGTGATATTAAACCTGCCAATATACTGTTAGATGAAAAGTACTTGCC

AAAGCTATCTGATTTCGGAATAGCAAGGCTGCTTTCTACTGATGAGGCC

CAGCGTACCAAAACTGTTATTGGTTGCATAGGTTATGTAGACCCTTTGT

TTTGTCAGAGTGGGATTCTAACTACAAAGAGTGATGTATACAGTTTTGG

AGTTGTTCTATTGGAAATGATTACCCGAAAGAAAGCGACGGACGGGACT

ACTAGTCTTACTCAATGTTTCGCCGAGGCAGTGGGAAGTGGGAAGAAGG

TGAGACAACTGTTTGATGTGGAAATTACCTATGACAAGAAGAAGATGAA

ATTGATCGAAGAAATTGTGAAGCTAGCAGTTACATGCTTGAGACTGGAT

GATAAAATGCGTCCGACAATGGTTGAGGTAGCAGATAGACTTAGGAGGA

TTAGAAAAGCTCTCCCGAAGCACAAGGGTGAAAGATCTACAGACATCAA

TAATTGGCACATAAGAAGAGGAAATGCACAGGATGTACCAACTATTTCC

CTTGATGAAATGAAGAAAATAACAAGGAACTTCAGTAATGGTGCTCTAA

TAGGAGAGAGTTCGCAAGGCAGAGTTTTCTTCAAAGTGTTAAAATATGG

ACCGGAATCTGCATTCAAGTCTTCTCAAGAAATTGATTTGAAGATTGAA

GCAATTTCGAGACTGAAACACGAGAACGTTGTCCAACTTCTCGGATGTT

GGGTCGAAGGAGACGAATATGTTCTTGCATATGAGTATACATTGGGTGG

CACCTTGCATGATATCCTTCACAGCAAGGGTAAAAAGGGTGTCAGGGGA

GCCAAGTCAAGGGCAGCTCTATCATGGATGCAGCGAGTGAAGATTGCCT

TAAGTGCAGCAGAAGGGCTGGAGTTCCTCCATCACAAGGCAGAGCCTCA

GGTCACCCATGGTAACATCATATCCAGCAAGATACTTCTCTTTGACAAC

GACATCGCAAAGGTTGGCGACGCTGGTATCTCCAATGTGTTGGTCAGTG

ACAACATGAGTAGATGTCATAGTTTTAGATGTGGCCTTGACCTGGATCG

TATGGATGGTCATGGTTATCACGAGGATGATTACCATGTCGATTTATAT

TCTGCTACTGGACAGTGCAACACAAAGAGTGATGTATATGCCTTCGGGG

TTGTGCTGCTGGAACTTTTAACCGGTCGTAAGGCAGTTGATCATACACT

ACCCCGCGGCAGGCAGAGCCTCGTGACATGGGTATGCACCCTTGGCGAG

AAGGGCCTATGCACCCATTGTGACAATACATCAATTCTATGGAAGATAA

TGTGTTGACAGAAACAAGTCTTAGTGAAGATAAGGTGCAGCGATGCGTG

GATCCAAGGCTTGAAGGAGATTACCCTCACAATGCTGTTACCAAGATGG

GTGCGATCGCAGCGCTATGTGTGCATTATAATCCAGATCTCCGACCAAA

CATGAGCACTGTCGTCAAGGGTCTGAGACAATTGCTGCACAGCGA.

In some embodiments, the sequence of the non-functional wtk1 consists of SEQ ID NO: 114).

In some embodiments, the sequence of the non-functional wtk1 is from *T. aestivum* cv. Claire. In some embodiments, the sequence of the non-functional wtk1 comprises (SEQ ID NO: 115)
ATGGATTACCAAGGAAACAATCTTAGTGATTTCTTTCAAGCTAATGGGCA

TTTGGTACTTAAAAGAGTGGACAACAACTATAAACTGCGGTCCTTCACAG

AAAAGGAGATAGAGCACATTACAGACAGATATAGCACTTCGCTTGGTAGT

GGCTCGTTCGGTGATGTCTACAAAGGAAGATTAGACGATCAACGTCCAGT

CGCAGTAAAGAGGTACAAAAATGGAACCAAGAAAGAGGAGTTCGCCAAGG

AGGTGATAGTGCATTCCCAGATAAACCACAAGAATGTTGTCAGATTGTTA

GGCTGCTGCACGGAGGAAAATGCCCTTATGATTGTTATGGAGTTTGTCTG

TAATGGAAACCTCTACAACATCCTTCACTGTAGCAATGCTGATGGTCCTA

TACTCTTCCCTTTGGACAAACGTTTGGACATCGCTATTGAATCAGCTGAA

GCACTATCATGCATGCATTCAATGTACAGTCCTGTCCTTCATGGTGATAT

TAAACCTGCCAATATACTGTTAGATGAAAAGTACTTGCCAAAGCTATCTG

ATTTCGGAATAGCAAGGCTGCTTTCTACTGATGAGGCCCAGCGTACCAAA

ACTGTTACTGGTTGCATAGGTTATGTAGACCCTTTGTTTTGTCAGAGTGG

GATTCTAACTACAAAGAGTGATGTATACAGTTTTGGAGTTGTTCTATTGG

AAATGATTACCCGAAAGAAAGCGACGGACGGGACTACTAGTCTTACTCAA

TGTTTCGCCGAGGCAGTGGGAAGTGGGAAGAAGGTGAGACAACTGTTTGA

TGTGGAAATTACCTATGACAAGAAGAAGATGAAATTGATCGAAAAATTGT

GAAGCTAGCAGTTACATGCTTGAGACTGGATGATAAAATGCGTCCGACAA

TGGTTGAGGTAGCAGATAGACTTAGGAGGATTAGAAAAGCTCTCCCGAAG

CACAAGGGTGAAAGCTCTACAGACATCAATAATTGGCACATAAGAAGAGG

AAATGCACAGGATGTACCAACTATTTCCCTTGATGAAATGAAGAAAATAA

CAAGGAACTTCAGTAATGGTGCTCTAATAGGAGAGAGTTCGCAAGGCAGA

GTTTTCTTCAAAGTGTTAAAATATGGACCGGAATCTGCATTCAAGTCTTC

TCAAGAAATTGATTTGAAGATTGAAGCAATTTCGAGACTGAAACACGAGA

ACGTTGTCCAACTTCTCGGATGTTGGGTCGAAGGAGACGAATATGTTCTT

GCATATGAGTATACATTGGGTGGCACCTTGCATGATATCCTTCACAGCAA

GGGTAAAAAGGGTGTCAGGGGAGCCAAGTCAAGGGCAGCTCTATCATGGA

TGCAGCGAGTGAAGATTGCCTTAAGTGCAGCAGAAGGGCTGGAGTTCCTC

CATCACAAGGCAGAGCCTCAGGTCACCCATGGTAACATCATATCCAGCAA

GATACTTCTCTTTGACAACGACATCGCAAAGGTTGGCGACGCTGGTATCT

CCAATGTGTTGGTCAGTGACAACATGAGTAGATGTCATAGTTTTAGATGT

GGCCTTGACCTGGATCGTATGGATGGTCATGGTTATCACGAGGATGATTA

CCATGTCAATTTATATTCTGCTACTGGACAGTGCAACACAAAGAGTGATG

-continued
TATATGCCTTCGGGGTTGTGCTGCTGGAACTTTTAACCGGTCGTAAGGCA

GTTGATCATACACTACCCCGCGGCAGGCAGAGCCTCGTGACATGGGTATG

CACCCTTGGCGAGAAGGGCCTATGCACCCATTGTGACAAGTAGCCCGTCC

TATCAGAATTGCCAACATATCTACCACAATGTTAAACAAGATAGGGGACA

TTGGGTGCAGCGATGCGTGGATCCAAGGCTTGAAGGAGATTACCCTCACA

ATGCTGTTACCAAGATGGGTGCGATCGCAGCGCTATGTGTGCATTATAAT

CCAGATCTCCGACCAAACATGAGCACTGTCGTCAAGGGTCTGAGACAATT

GCTGCACAGCGA.

In some embodiments, the sequence of the non-functional wtk1 consists of SEQ ID NO: 115).

In some embodiments, the sequence of the non-functional wtk1 is from *T. aestivum* cv. Paragon. In some embodiments, the sequence of the non-functional wtk1 comprises (SEQ ID NO: 116)
ATGGATTACCAAGGAAACAATCTTAGTGATTTCTTTCAAGCTAATGGGCA

TTTGGTACTTAAAAGAGTGGACAACAACTATAAACTGCGGTCCTTCACAG

AAAAGGAGATAGAGCACATTACAGACAGATATAGCACTTCGCTTGGTAGT

GGCTCGTTCGGTGATGTCTACAAAGGAAGATTAGACGATCAACGTCCAGT

CGCAGTAAAGAGGTACAAAAATGGAACCAAGAAAGAGGAGTTCGCCAAGG

AGGTGATAGTGCATTCCCAGATAAACCACAAGAATGTTGTCAGATTGTTA

GGCTGCTGCACGGAGGAAAATGCCCTTATGATTGTTATGGAGTTTGTCTG

TAATGGAAACCTCTACAACATCCTTCACTGTAGCAATGCTGATGGTCCTA

TACTCTTCCCTTTGGACAAACGTTTGGACATCGCTATTGAATCAGCTGAA

GCACTATCATGCATGCATTCAATGTACAGTCCTGTCCTTCATGGTGATAT

TAAACCTGCCAATATACTGTTAGATGAAAAGTACTTGCCAAAGCTATCTG

ATTTCGGAATAGCAAGGCTGCTTTCTACTGATGAGGCCCAGCGTACCAAA

ACTGTTACTGGTTGCATAGGTTATGTAGACCCTTTGTTTTGTCAGAGTGG

GATTCTAACTACAAAGAGTGATGTATACAGTTTTGGAGTTGTTCTATTGG

AAATGATTACCCGAAAGAAAGCGACGGACGGGACTACTAGTCTTACTCAA

TGTTTCGCCGAGGCAGTGGGAAGTGGGAAGAAGGTGAGACAACTGTTTGA

TGTGGAAATTACCTATGACAAGAAGAAGATGAAATTGATCGAAAAATTGT

GAAGCTAGCAGTTACATGCTTGAGACTGGATGATAAAATGCGTCCGACAA

TGGTTGAGGTAGCAGATAGACTTAGGAGGATTAGAAAAGCTCTCCCGAAG

CACAAGGGTGAAAGCTCTACAGACATCAATAATTGGCACATAAGAAGAGG

AAATGCACAGGATGTACCAACTATTTCCCTTGATGAAATGAAGAAAATAA

CAAGGAACTTCAGTAATGGTGCTCTAATAGGAGAGAGTTCGCAAGGCAGA

GTTTTCTTCAAAGTGTTAAAATATGGACCGGAATCTGCATTCAAGTCTTC

TCAAGAAATTGATTTGAAGATTGAAGCAATTTCGAGACTGAAACACGAGA

ACGTTGTCCAACTTCTCGGATGTTGGGTCGAAGGAGACGAATATGTTCTT

GCATATGAGTATACATTGGGTGGCACCTTGCATGATATCCTTCACAGCAA

GGGTAAAAAGGGTGTCAGGGGAGCCAAGTCAAGGGCAGCTCTATCATGGA

TGCAGCGAGTGAAGATTGCCTTAAGTGCAGCAGAAGGGCTGGAGTTCCTC

-continued
CATCACAAGGCAGAGCCTCAGGTCACCCATGGTAACATCATATCCAGCAA

GATACTTCTCTTTGACAACGACATCGCAAAGGTTGGCGACGCTGGTATCT

CCAATGTGTTGGTCAGTGACAACATGAGTAGATGTCATAGTTTTAGATGT

GGCCTTGACCTGGATCGTATGGATGGTCATGGTTATCACGAGGATGATTA

CCATGTCAATTTATATTCTGCTACTGGACAGTGCAACACAAAGAGTGATG

TATATGCCTTCGGGGTTGTGCTGCTGGAACTTTTAACCGGTCGTAAGGCA

GTTGATCATACACTACCCCGCGGCAGGCAGAGCCTCGTGACATGGGTATG

CACCCTTGGCGAGAAGGGCCTATGCACCCATTGTGACAAGTAGCCCGTCC

TATCAGAATTGCCAACATATCTACCACAATGTTAAACAAGATAGGGGACA

TTGGGTGCAGCGATGCGTGGATCCAAGGCTTGAAGGAGATTACCCTCACA

ATGCTGTTACCAAGATGGGTGCGATCGCAGCGCTATGTGTGCATTATAAT

CCAGATCTCCGACCAAACATGAGCACTGTCGTCAAGGGTCTGAGACAATT

GCTGCACAGCGA.

In some embodiments, the sequence of the non-functional wtk1 consists of SEQ ID NO: 116).

In some embodiments, the sequence of the non-functional wtk1 is from *T. aestivum* cv. Robigus. In some embodiments, the sequence of the non-functional wtk1 comprises (SEQ ID NO: 117)
ATGGATTACCAAGGAAACAATCTTAGTGATTTCTTTCAAGCTAATGGGCA

TTTGGTACTTAAAAGAGTGGACAACAACTATAAACTGCGGTCCTTCACAG

AAAAGGAGATAGAGCACATTACAGACAGATATAGCACTTCGCTTGGTAGT

GGCTCGTTCGGTGATGTCTACAAAGGAAGATTAGACGATCAACGTCCAGT

CGCAGTAAAGAGGTACAAAAATGGAACCAAGAAAGAGGAGTTCGCCAAGG

AGGTGATAGTGCATTCCCAGATAAACCACAAGAATGTTGTCAGATTGTTA

GGCTGCTGCACGGAGGAAAATGCCCTTATGATTGTTATGGAGTTTGTCTG

TAATGGAAACCTCTACAACATCCTTCACTGTAGCAATGCTGATGGTCCTA

TACTCTTCCCTTTGGACAAACGTTTGGACATCGCTATTGAATCAGCTGAA

GCACTATCATGCATGCATTCAATGTACAGTCCTGTCCTTCATGGTGATAT

TAAACCTGCCAATATACTGTTAGATGAAAAGTACTTGCCAAAGCTATCTG

ATTTCGGAATAGCAAGGCTGCTTTCTACTGATGAGGCCCAGCGTACCAAA

ACTGTTACTGGTTGCATAGGTTATGTAGACCCTTTGTTTTGTCAGAGTGG

GATTCTAACTACAAAGAGTGATGTATACAGTTTTGGAGTTGTTCTATTGG

AAATGATTACCCGAAAGAAAGCGACGGACGGGACTACTAGTCTTACTCAA

TGTTTCGCCGAGGCAGTGGGAAGTGGGAAGAAGGTGAGACAACTGTTTGA

TGTGGAAATTACCTATGACAAGAAGAAGATGAAATTGATCGAAAAATTGT

GAAGCTAGCAGTTACATGCTTGAGACTGGATGATAAAATGCGTCCGACAA

TGGTTGAGGTAGCAGATAGACTTAGGAGGATTAGAAAAGCTCTCCCGAAG

CACAAGGGTGAAAGCTCTACAGACATCAATAATTGGCACATAAGAAGAGG

AAATGCACAGGATGTACCAACTATTTCCCTTGATGAAATGAAGAAAATAA

CAAGGAACTTCAGTAATGGTGCTCTAATAGGAGAGAGTTCGCAAGGCAGA

GTTTTCTTCAAAGTGTTAAAATATGGACCGGAATCTGCATTCAAGTCTTC

-continued
```
TCAAGAAATTGATTTGAAGATTGAAGCAATTTCGAGACTGAAACACGAGA

ACGTTGTCCAACTTCTCGGATGTTGGGTCGAAGGAGACGAATATGTTCTT

GCATATGAGTATACATTGGGTGGCACCTTGCATGATATCCTTCACAGCAA

GGGTAAAAAGGGTGTCAGGGGAGCCAAGTCAAGGGCAGCTCTATCATGGA

TGCAGCGAGTGAAGATTGCCTTAAGTGCAGCAGAAGGGCTGGAGTTCCTC

CATCACAAGGCAGAGCCTCAGGTCACCCATGGTAACATCATATCCAGCAA

GATACTTCTCTTTGACAACGACATCGCAAAGGTTGGCGACGCTGGTATCT

CCAATGTGTTGGTCAGTGACAACATGAGTAGATGTCATAGTTTTAGATGT

GGCCTTGACCTGGATCGTATGGATGGTCATGGTTATCACGAGGATGATTA

CCATGTCAATTTATATTCTGCTACTGGACAGTGCAACACAAAGAGTGATG

TATATGCCTTCGGGGTTGTGCTGCTGGAACTTTTAACCGGTCGTAAGGCA

GTTGATCATACACTACCCCGCGGCAGGCAGAGCCTCGTGACATGGGTATG

CACCCTTGGCGAGAAGGGCCTATGCACCCATTGTGACAAGTAGCCCGTCC

TATCAGAATTGCCAACATATCTACCACAATGTTAAACAAGATAGGGGACA

TTGGGTGCAGCGATGCGTGGATCCAAGGCTTGAAGGAGATTACCCTCACA

ATGCTGTTACCAAGATGGGTGCGATCGCAGCGCTATGTGTGCATTATAAT

CCAGATCTCCGACCAAACATGAGCACTGTCGTCAAGGGTCTGAGACAATT

GCTGCACAGCGA.
```

In some embodiments, the sequence of the non-functional wtk1 consists of SEQ ID NO: 117).

In some embodiments, the sequence of the non-functional wtk1 comprises any one of SEQ ID NO: 111-117. In some embodiments, the sequence of the non-functional wtk1 consists of any one of SEQ ID NO: 111-117. In some embodiments, the sequence of the non-functional wtk1 comprises the introns associated with any one of SEQ ID NOs: 111-117. In some embodiments, the sequence of the non-functional wtk1 comprises 2 kilobases upstream and/or downstream of any part of SEQ ID NOs: 111-117.

In some embodiments, the nucleic acid molecule capable of binding differentially is a primer. As used herein, the term "primer" includes an oligonucleotide, either natural or synthetic, that is capable, upon forming a duplex with a polynucleotide template, of acting as a point of initiation of nucleic acid synthesis and being extended from its 3' end along the template so that an extended duplex is formed. Primers within the scope of the present invention bind at the target sequence. A "primer" may be considered a short polynucleotide, generally with a free 3'-OH group that binds to a target or template potentially present in a sample of interest by hybridizing with the target, and thereafter promoting polymerization of a polynucleotide complementary to the target. Primers of the invention are comprised of nucleotides ranging from 8 to 30 nucleotides. In one aspect, the primer is at least 8 nucleotides, or alternatively at least 9 nucleotides, or alternatively at least 10 nucleotides, or alternatively at least 11 nucleotides, or alternatively at least 12 nucleotides, or alternatively at least 13 nucleotides, or alternatively at least 14 nucleotides, or alternatively at least 15 nucleotides, or alternatively at least 16 nucleotides, or alternatively at least 17 nucleotides, or alternatively, at least 18 nucleotides, or alternatively, at least 19 nucleotides, or alternatively, at least 20 nucleotides, or alternatively, at least 21 nucleotides, or alternatively, at least 22 nucleotides, or alternatively, at least 23 nucleotides, or alternatively, at least 24 nucleotides, or alternatively, at least 25 nucleotides, or alternatively, at least 26 nucleotides, or alternatively, at least 27 nucleotides, or alternatively, at least 28 nucleotides, or alternatively, at least 29 nucleotides, or alternatively, at least 30 nucleotides. In one embodiment, the primer is at most 40 nucleotides, or alternatively at most 50 nucleotides, or alternatively at most 75 nucleotides or alternatively at most 100 nucleotides.

As used herein, "differential binding" refers to the ability to bind to one molecule with greater affinity than another molecule. In some embodiments, differential binding is the ability to bind to one molecule and to not bind the other molecule at all. In some embodiments, differential binding is the ability to bind to one molecule and to negligibly bind the other molecule. In some embodiments, differential binding is at least a 10%, 20%, 30%, 40%, 50%, 60%, 70%, 80%, 90%, 95%, or 99% greater binding to one molecules as compared to the other. Each possibility represents a separate embodiment of the invention. In some embodiments, the molecule binds better to Wtk1. In some embodiments, the molecule binds better to wtk1. In some embodiments, the molecule binds with 100% complementarity to Wtk1, but only negligibly with wtk1. In some embodiments, the molecule binds with 100% complementarity to wtk1, but only negligibly with Wtk1. In some embodiments, the molecule binds with 100% complementarity to Wtk1 or wtk1, but not to both. In some embodiments, the molecule binds with 100% complementarity to Wtk1, and with less than 99%, 98%, 97%, or 96% complementarity to wtk1. Each possibility represents a separate embodiment of the invention. In some embodiments, the molecule binds with 100% complementarity to wtk1, and with less than 99%, 98%, 97%, or 96% complementarity to Wtk1. Each possibility represents a separate embodiment of the invention. In some embodiments, the molecule binds with 100% complementarity to Wtk1, and all nucleotides of the primer complement wtk1 except for the most 3' nucleotide. In some embodiments, the molecule binds with 100% complementarity to wtk1, and all nucleotides of the primer complement Wtk1 except for the most 3' nucleotide.

In some embodiments, the nucleic acid molecule with differential binding comprises at least one single nucleotide polymorphism (SNP) that differentiates between a functional Wtk1 nucleic acid molecule and a non-functional wtk1 nucleic acid molecule. SNPs are well known in the art, and are used for genotyping different alleles of a gene or genomic region. Any nucleotides which are different between the functional Wtk1 provided herein and a non-functional wtk1 are to be considered as SNPs that may be used for practicing the invention. Examples of such SNPs are provided in Table 15.

TABLE 15

Identified SNPs between the functional allele of Wtk1 from G25 and the six non-functional alleles.

| Position in WTK1 from G25 | *T. dicoccoides* G25 | *T. dicoccoides Zavitan* | *T. durum Svevo* and *Kronos* | *T. aestivum* CS | *T. aestivum Cadenza, Claire, Paragon* and *Robigus* | General for all non-functional |
|---|---|---|---|---|---|---|
| 22 | T | C | — | C | C | No |
| 26 | A | A | — | A | G | No |

TABLE 15-continued Identified SNPs between the functional allele of
Wtk1 from G25 and the six non-functional alleles.

| Position in WTK1 from G25 | T. dicoccoides G25 | T. dicoccoides Zavitan | T. durum Svevo and Kronos | T. aestivum CS | T. aestivum Cadenza, Claire, Paragon and Robigus | General for all non-functional |
|---|---|---|---|---|---|---|
| 40 | A | A | — | A | G | No |
| 54 | T | G | — | G | G | No |
| 66 | A | T | — | T | A | No |
| 90 | G | A | — | A | G | No |
| 99 | T | T | — | C | T, A | No |
| 112 | G | A | — | A | G | No |
| 123 | A | G | — | G | A | No |
| 124 | G | A | — | A | G | No |
| 126 | C | A | — | A | C | No |
| 140 | C | T | — | T | C | No |
| 149 | A | G | — | G | G | No |
| 186 | C | T | — | T | C | No |
| 195 | T | C | — | C | T | No |
| 206 | T | T | A | T | T | No |
| 207 | A | A | T | A | A | No |
| 213 | A | A | A | A | G | No |
| 231 | G | T | T | T | G | No |
| 240 | G | G | A | G | G | No |
| 243 | T | C | C | C | C | Yes |
| 264 | T | C | T | C | T | No |
| 277 | C | C | A | C | C | No |
| 279 | T | C | C | C | C | Yes |
| 285 | C | T | T | T | T | Yes |
| 293 | G | A | G | A | G | No |
| 303 | C | A | C | A | C | No |
| 311 | C | C | C | T | C | No |
| 312 | A | A | C | A | G | No |
| 324 | T | T | C | T | C | No |
| 325 | C | C | C | A | C | No |
| 327 | T | T | A | T | T | No |
| 346 | A | A | A | A | G | No |
| 366 | C | C | T | C | C | No |
| 368 | A | A | G | A | A | No |
| 382 | G | G | G | G | A | No |
| 389 | C | C | T | C | C | No |
| 390 | A | T | T | T | T | Yes |
| 402 | C | C | C | C | A | No |
| 404 | C | C | C | C | T | No |
| 405 | C | T | C | T | C | No |
| 410 | C | A | C | A | C | No |
| 415 | G | C | T | C | G | No |
| 435 | C | C | C | C | T | No |
| 438 | C | T | T | T | T | Yes |
| 441 | G | G | G | G | A | No |
| 443 | C | C | T | C | C | No |
| 447 | G | T | T | T | T | Yes |
| 453 | A | G | A | G | A | No |
| 462 | C | T | T | T | C | No |
| 471 | A | A | G | A | A | No |
| 498 | C | C | C | C | T | No |
| 522 | G | G | G | G | A | No |
| 527 | A | G | A | G | A | No |
| 555 | C | C | C | T | C | No |
| 567 | A | A | A | A | G | No |
| 568 | C | T | T | T | C | No |
| 570 | G | G | C | G | G | No |
| 580 | G | G | T | G | G | No |
| 582 | T | C | C | C | T | No |
| 598 | A | A | G | A | A | No |
| 608 | T | T | T | T | T, C | No |
| 627 | A | G | G | G | A | No |
| 648 | C | T | T | T | T | Yes |
| 651 | T | G | G | G | G | Yes |
| 652 | A | A | G | A | A | No |
| 657 | A | C | G | C | A | No |
| 696 | G | G | G | G | A | No |
| 708 | C | C | C | C | T | No |
| 717 | A | G | G | G | G | Yes |
| 729 | T | C | G | C | C | No |
| 733 | G | G | G | G | A | No |
| 757 | G | T | G | T | G | No |
| 758 | C | C | T | C | C | No |

TABLE 15-continued

Identified SNPs between the functional allele of
Wtk1 from G25 and the six non-functional alleles.

| Position in WTK1 from G25 | T. dicoccoides G25 | T. dicoccoides Zavitan | T. durum Svevo and Kronos | T. aestivum CS | T. aestivum Cadenza, Claire, Paragon and Robigus | General for all non-functional |
|---|---|---|---|---|---|---|
| 759 | C | T | C | T | C | No |
| 762 | G | G | A | G | G | No |
| 765 | C | C | C | C | A | No |
| 766 | C | C | C | C | G | No |
| 769 | G | C | G | G | G | No |
| 771 + 1 | — | A | A | A | A | Yes |
| 771 + 2 | — | G | G | G | G | Yes |
| 771 + 3 | — | A | A | A | T | No |
| 790 | T | C | C | C | C | Yes |
| 808 | G | G | G | G | A | No |
| 811 | A | A | A | A | T | No |
| 818 | A | A | G | A | A | No |
| 822 | G | C | G | C | G | No |
| 824 | A | — | A | A | A | No |
| 825 | G | — | G | G | G | No |
| 826 | G | — | A | A | A | No |
| 828 | G | T | G | T | G | No |
| 831 | A | G | A | G | A | No |
| 841 | G | G | G | G | G, — | No |
| 843 | T | T | T | T | A | No |
| 848 | C | C | C | C | T | No |
| 849 | G | A | G | A | G | No |
| 852 | G | G | A | G | G | No |
| 853 | T | C | C | C | C | Yes |
| 860 | C | C | C | C | T | No |
| 872 | A | G | G | G | G | Yes |
| 879 | G | T | T | T | T | Yes |
| 891 | T | T | C | T | T | No |
| 900 | G | T | G | T | G | No |
| 914 | A | A | G | A | A | No |
| 915 | T | T | C | T | T | No |
| 926 | G | G | T | G | G | No |
| 945 | C | G | C | C | G | No |
| 946 | C | C | C | C | A | No |
| 950 | G | G | A | G | A | No |
| 955 | G | A | G | A | G | No |
| 963 | C | C | C | C | A, C | No |
| 971 | G | G | A | G | A | No |
| 978 | C | C | C | C | T | No |
| 982 | G | G | T | G | T | No |
| 986 | T | T | T | T | A | No |
| 995 | C | G | G | G | G | Yes |
| 1002 | G | G | G | G | T | No |
| 1006 | G | G | G | G | C | No |
| 1010 | A | A | T | A | A | No |
| 1012 | C | G | G | G | G | Yes |
| 1045 | C | A | A | A | A | Yes |
| 1053 | A | A | G | A | G | No |
| 1059 | C | C | C | T | C | No |
| 1063 | G | A | A | A | A | Yes |
| 1072 | C | T | C | T | C | No |
| 1086 | C | C | C | C | T | No |
| 1089 | A | A | A | A | G | No |
| 1096 | A | A | T | A | A | No |
| 1104 | G | C | C | C | C | Yes |
| 1108 | G | A | A | A | A | Yes |
| 1112 | A | T | T | T | T | Yes |
| 1118 | G | A | A | A | A | Yes |
| 1119 | T | A | A | A | A | Yes |
| 1125 | A | A | T | A | A | No |
| 1126 | A | C | C | A | A | No |
| 1127 | A | C | T | C | C | No |
| 1129 | A | G | G | G | G | Yes |
| 1130 | G | A | A | A | A | Yes |
| 1132 | T | T | A | T | T | No |
| 1133 | A | A | C | A | C | No |
| 1140 | C | C | A | C | C | No |
| 1141 | A | A | G | A | A | No |
| 1142 | A | A | G | A | A | No |
| 1143 | G | G | A | G | G | No |
| 1146 | T | T | A | T | T | No |
| 1148 | C | C | G | C | C | No |

TABLE 15-continued

Identified SNPs between the functional allele of
Wtk1 from G25 and the six non-functional alleles.

| Position in WTK1 from G25 | T. dicoccoides G25 | T. dicoccoides Zavitan | T. durum Svevo and Kronos | T. aestivum CS | T. aestivum Cadenza, Claire, Paragon and Robigus | General for all non-functional |
|---|---|---|---|---|---|---|
| 1149 | T | T | G | T | T | No |
| 1151 | A | A | G | A | A | No |
| 1152 | A | A | G | A | A | No |
| 1153 | G | G | T | G | G | No |
| 1154 | A | A | G | A | A | No |
| 1155 | A | A | T | A | A | No |
| 1156 | A | A | G | A | A | No |
| 1157 + 1 | — | — | A | — | C | No |
| 1159 | G | G | C | G | G | No |
| 1160 | A | A | G | A | A | No |
| 1162 | T | T | A | T | T | No |
| 1166 | A | A | T | A | A | No |
| 1174 | G | G | A | G | G | No |
| 1176 | A | G | A | G | A | No |
| 1182 | A | A | A | A | G | No |
| 1194 | C | C | T | C | C | No |
| 1195 | A | G | G | G | G | Yes |
| 1203 | T | T | — | T | T | No |
| 1210 | C | C | T | C | C | No |
| 1218 | A | G | A | G | A | No |
| 1219 | A | T | C | T | T | No |
| 1220 | A | A | A | A | G | No |
| 1234 | A | G | G | G | G | Yes |
| 1237 | A | A | G | A | G | No |
| 1248 | T | T | G | T | T | No |
| 1251 | T | T | A | T | A | No |
| 1254 | C | C | T | — | T | No |
| 1261 | G | G | A | G | A | No |
| 1262 | T | C | T | C | C | No |
| 1265 | C | C | C | C | T | No |
| 1266 | G | G | A | G | G | No |
| 1269 | G | G | T | G | T | No |
| 1275 | G | T | C | T | C | No |
| 1287 | T | T | C | T | C | No |
| 1296 | A | C | C | C | C | Yes |
| 1297 | G | G | A | G | A | No |
| 1301 | G | A | G | A | G | No |
| 1302 | T | A | T | A | T | No |
| 1303 | G | A | A | A | A | Yes |
| 1304 | A | T | A | T | A | No |
| 1305 | T | C | A | C | A | No |
| 1306 | A | C | A | C | A | No |
| 1307 | A | A | T | A | A | No |
| 1310 | G | C | G | C | G | No |
| 1311 | T | C | T | C | T | No |
| 1312 | G | G | A | G | G | No |
| 1314 | C | C | T | C | C | No |
| 1315 | A | G | A | G | A | No |
| 1316 | G | G | A | G | G | No |
| 1317 | T | C | T | C | G | No |
| 1317 + 1 | — | A | — | — | — | No |
| 1317 + 2 | — | A | — | — | — | No |
| 1317 + 3 | — | A | — | — | — | No |
| 1317 + 4 | — | T | — | — | — | No |
| 1317 + 5 | — | C | — | — | — | No |
| 1320 | A | T | T | T | A | No |
| 1325 | G | A | A | A | A | Yes |
| 1326 | G | G | A | G | G | No |
| 1327 | C | T | T | T | T | Yes |
| 1330 | G | G | C | G | A | No |
| 1332 | A | A | A | A | G | No |
| 1333 | G | A | G | A | G | No |
| 1336 | G | G | G | A | G | No |
| 1337 | C | T | C | T | C | No |
| 1354 | A | A | A | A | C | No |
| 1380 | A | A | T | A | A | No |
| 1389 | T | T | T | T | G | No |
| 1404 | G | T | T | T | C | No |
| 1415 | C | C | G | C | C | No |
| 1428 | C | C | C | C | T | No |
| 1440 | G | G | G | G | A | No |
| 1467 | A | C | C | C | C | Yes |

TABLE 15-continued

Identified SNPs between the functional allele of
Wtk1 from G25 and the six non-functional alleles.

| Position in WTK1 from G25 | T. dicoccoides G25 | T. dicoccoides Zavitan | T. durum Svevo and Kronos | T. aestivum CS | T. aestivum Cadenza, Claire, Paragon and Robigus | General for all non-functional |
|---|---|---|---|---|---|---|
| 1470 | T | T | C | T | C | No |
| 1472 | A | T | T | T | T | Yes |
| 1473 | T | C | C | C | C | Yes |
| 1480 | G | G | A | G | G | No |
| 1487 | G | A | A | A | A | Yes |
| 1490 | T | T | T | T | C | No |
| 1491 | T | C | T | C | T | No |
| 1494 | T | C | T | C | T | No |
| 1497 | C | A | C | A | C | No |
| 1506 | A | G | A | G | G | No |
| 1507 | C | C | C | C | T | No |
| 1512 | G | C | C | C | C | Yes |
| 1513 | C | A | A | A | A | Yes |
| 1518 | T | T | T | T | C | No |
| 1519 | A | G | G | G | A | No |
| 1525 | G | G | C | G | A | No |
| 1526 | T | A | G | A | G | No |
| 1528 | C | A | A | A | A | Yes |
| 1529 | A | G | G | G | G | Yes |
| 1530 | C | C | C | C | A | No |
| 1533 | T | T | C | T | T | No |
| 1536 | C | T | T | T | T | Yes |
| 1546 | C | T | C | T | T | No |
| 1547 | A | G | G | G | G | Yes |
| 1548 | G | G | G | G | T | No |
| 1550 | A | A | A | A | G | No |
| 1552 | T | C | T | C | C | No |
| 1553 | G | T | G | T | T | No |
| 1558 | A | A | A | A | C | No |
| 1559 | T | C | T | C | T | No |
| 1561 | G | G | A | G | G | No |
| 1570 | G | A | G | A | G | No |
| 1574 | G | A | G | A | G | No |
| 1576 | A | C | C | C | C | Yes |
| 1577 | T | A | G | A | A | No |
| 1579 | C | T | G | T | G | No |
| 1580 | G | A | G | G | G | No |
| 1583 | A | A | T | A | A | No |
| 1586 | A | A | G | A | A | No |
| 1588 | C | C | C | C | G | No |
| 1589 | C | A | C | A | A | No |
| 1590 | A | A | A | A | G | No |
| 1594 | G | G | C | G | G | No |
| 1600 | T | C | C | C | C | Yes |
| 1606 | G | G | G | G | A | No |
| 1609 | C | G | C | G | T | No |
| 1615 | G | G | G | G | T | No |
| 1632 | T | C | C | C | C | Yes |
| 1636 | G | A | A | A | A | Yes |
| 1644 | C | T | C | T | T | No |
| 1653 | C | C | C | C | T | No |
| 1654 | G | G | T | G | G | No |
| 1655 | C | C | T | C | C | No |
| 1675 | G | A | G | A | G | No |
| 1677 | G | A | G | A | A | No |
| 1685 | C | C | G | C | C | No |
| 1692 | C | T | C | T | T | No |
| 1693 | G | A | A | A | A | Yes |
| 1708 | G | A | A | A | A | Yes |
| 1717 | A | C | C | C | C | Yes |
| 1718 | A | G | A | G | G | No |
| 1719 | A | C | G | C | C | No |
| 1724 | A | G | G | G | G | Yes |
| 1748 | A | G | G | G | G | Yes |
| 1751 | A | C | C | C | C | Yes |
| 1754 | A | T | T | T | T | Yes |
| 1759 | G | A | G | A | G | No |
| 1762 | G | A | A | A | A | Yes |
| 1765 | A | A | G | A | G | No |
| 1766 | A | A | G | A | G | No |
| 1766 + 1 | — | C | C | C | C | Yes |
| 1766 + 2 | — | C | C | C | C | Yes |

TABLE 15-continued

Identified SNPs between the functional allele of
Wtk1 from G25 and the six non-functional alleles.

| Position in WTK1 from G25 | T. dicoccoides G25 | T. dicoccoides Zavitan | T. durum Svevo and Kronos | T. aestivum CS | T. aestivum Cadenza, Claire, Paragon and Robigus | General for all non-functional |
|---|---|---|---|---|---|---|
| 1766 + 3 | — | T | T | T | T | Yes |
| 1766 + 4 | — | A | A | A | A | Yes |
| 1766 + 5 | — | T | T | T | T | Yes |
| 1767 | A | G | G | G | G | Yes |
| 1768 | A | C | C | C | C | Yes |
| 1769 | G | A | A | A | A | Yes |
| 1770 | C | A | C | A | C | No |
| 1775 | G | T | T | T | T | Yes |
| 1777 | A | T | T | T | T | Yes |
| 1780 | T | C | C | C | C | Yes |
| 1781 | G | G | G | G | A | No |
| 1782 | G | A | A | A | A | Yes |
| 1783 | G | G | G | G | T, G | No |
| 1784 | A | C | C | C | A, T | No |
| 1785 | A | A | A | A | C, A | No |
| 1786 | A | T | T | T | A, G | No |
| 1787 | A | A | A | A | T, C | No |
| 1789 | A | A | A | A | A, C | No |
| 1790 | A | A | A | A | A, G | No |
| 1792 | A | T | T | T | T, C | No |
| 1793 | T | T | T | T | C | No |
| 1797 | G | G | G | G | G, C | No |
| 1798 | G | G | G | T | G, A | No |
| 1799 | A | A | A | T | A, G | No |
| 1800 + 1 | — | — | — | — | —, A | No |
| 1800 + 2 | — | — | — | — | —, T | No |
| 1800 + 3 | — | — | — | — | —, T | No |
| 1802 | A | A | A | A | A, C | No |
| 1803 | C | C | C | C | T, C | No |
| 1806 | T | T | T | T | T, C | No |
| 1807 | G | G | G | G | G, A | No |
| 1809 | G | G | G | G | G, A | No |
| 1811 | T | T | T | T | T, C | No |
| 1812 | A | A | A | A | G, T | No |
| 1813 | A | C | A | A | A | No |
| 1815 | A | A | A | A | A, C | No |
| 1816 | A | A | A | A | G, A | No |
| 1816 + 1 | — | — | — | — | —, C | No |
| 1816 + 2 | — | — | — | — | —, A | No |
| 1816 + 3 | — | — | — | — | —, A | No |
| 1816 + 4 | — | — | — | — | —, T | No |
| 1816 + 5 | — | — | — | — | —, G | No |
| 1816 + 6 | — | — | — | — | —, T | No |
| 1816 + 7 | — | — | — | — | —, T | No |
| 1824 | T | T | T | T | T, A | No |
| 1825 | T | T | T | T | C, — | No |
| 1826 | T | T | T | T | T, — | No |
| 1830 | T | T | T | T | T, G | No |
| 1832 | A | A | A | A | A, G | No |
| 1834 | G | G | G | G | G, C | No |
| 1837 | A | A | A | A | A, T | No |
| 1838 | T | A | A | A | A, G | No |
| 1852 | G | A | A | A | G | No |
| 1860 | A | A | A | G | A | No |
| 1867 | A | G | G | G | G | Yes |
| 1873 | T | G | G | G | G | Yes |
| 1880 | A | C | C | C | C | Yes |
| 1883 | G | G | G | G | A | No |
| 1886 | G | A | A | A | A | Yes |
| 1892 | T | C | C | C | T | No |
| 1914 | G | G | A | G | A | No |
| 1915 | T | G | G | G | G | Yes |
| 1923 | C | T | T | T | T | Yes |
| 1927 | A | A | C | A | C | No |
| 1932 | C | C | C | C | T | No |
| 1980 | G | A | A | A | A | Yes |
| 1987 | T | C | C | C | C | Yes |
| 1989 | G | A | G | A | G | No |
| 1992 | A | C | A | C | C | No |
| 1994 | A | A | T | A | A | No |

TABLE 15-continued

Identified SNPs between the functional allele of
Wtk1 from G25 and the six non-functional alleles.

| Position in WTK1 from G25 | T. dicoccoides G25 | T. dicoccoides Zavitan | T. durum Svevo and Kronos | T. aestivum aestivum CS | T. aestivum Cadenza, Claire, Paragon and Robigus | General for all non-functional |
|---|---|---|---|---|---|---|
| 1994 | A | — | A | — | — | No |
| 1996 | T | C | T | C | C | No |

Absent bases are marked as "—". Bases in insertions in non-functional copies are marked as "—" in the G25 copy. Positions in insertions are marked as "position+" relative to WTK1 in G25.

The term "complementary" refers to the ability of polynucleotides to form base pairs with one another. Base pairs are typically formed by hydrogen bonds between nucleotide units in antiparallel polynucleotide strands. Complementary polynucleotide strands can base pair in the Watson-Crick manner (e.g., A to T, A to U, C to G), or in any other manner that allows for the formation of duplexes. As persons skilled in the art are aware, when using RNA as opposed to DNA, uracil rather than thymine is the base that is considered to be complementary to adenosine. However, when a U is denoted in the context of the present invention, the ability to substitute a T is implied, unless otherwise stated. Perfect complementarity or 100% complementarity refers to the situation in which each nucleotide unit of one polynucleotide strand can hydrogen bond with a nucleotide unit of a second polynucleotide strand. Less than perfect complementarity refers to the situation in which some, but not all, nucleotide units of two strands can hydrogen bond with each other. For example, for two 20-mers, if only two base pairs on each strand can hydrogen bond with each other, the polynucleotide strands exhibit 10% complementarity. In the same example, if 18 base pairs on each strand can hydrogen bond with each other, the polynucleotide strands exhibit 90% complementarity.

As used herein, the term "confers resistance" refers to increasing the survival of a plant or cell when challenged with a pathogen i.e. Pst. In some embodiments, increasing survival is a decrease in the growth of the pathogen. In some embodiments, increasing survival is a decrease in the spread of the pathogen. In some embodiments, increasing survival comprises lack of infection by the pathogen. In some embodiments, resistance comprises not being able to be infected by the pathogen. In some embodiments resistance comprises increased survival as compared to survival without the vector, DNA, or protein of the invention. In some embodiments, the increase refers to at least 10% increase, 20% increase, 30% increase, 40% increase, 50% increase, 60% increase, 70% increase, 80% increase, 90% increase, or 100% increase in survival. Each possibility represents a separate embodiment of the invention. In some embodiments, the decrease refers to at least 10% decrease, 20% decrease, 30% decrease, 40% decrease, 50% decrease, 60% decrease, 70% decrease, 80% decrease, 90% decrease, or 100% decrease. Each possibility represents a separate embodiment of the invention.

In some embodiments, a molecule of the invention comprises the sequence provided in any one of SEQ ID NO: 69-70 and 103-110. In some embodiments, a molecule of the invention consists of the sequence provided in any one of SEQ ID NO: 69-70 and 103-110. In some embodiments, a molecule of the invention comprises the sequence provided in any one of SEQ ID NO: 61-110. In some embodiments, a molecule of the invention consists of the sequence provided in any one of SEQ ID NO: 61-110.

By another aspect, there is provided an isolated nucleic acid molecule comprising the sequence of any one of SEQ ID NOs: 61-110. In some embodiments, the nucleic acid molecule consists of a sequence provided in one of SEQ ID NOs: 61-110. By another aspect, there is provided an isolated nucleic acid molecule comprising the sequence of any one of SEQ ID NOs: 69-70 and 103-110. In some embodiments, the nucleic acid molecule consists of a sequence provided in one of SEQ ID 69-70 and 103-110. In some embodiments, the isolated nucleic acid molecule is a primer.

In some embodiments, the isolated molecules of the invention further comprise a tag. As used herein, a "tag" is any moiety or molecule that can be used to identify or isolate the molecule of the invention. In some embodiments, the tag is selected from a fluorescent tag, a chemiluminescent tag, a colored dye tag, a radioactive tag, a chemically modified nucleotide and a protein including an enzyme, a peptide or a ligand. In some embodiments, the fluorescent tag is a fluorescence resonance energy transfer (FRET) tag.

The tag may be identified by any means known to one skilled in the art, and may include, but is not limited to, microscopy, fluorescent sorting, binding to affinity substrates and high-performance liquid chromatography (HPLC). In some embodiments, PCR followed by measuring fluorescence is used to identify and quantify the tag. In some embodiments, FRET is used to identify and quantify the tag.

In some embodiments, the primers and nucleic acid molecules of the invention are for use in detecting a functional Wtk1 gene in a sample. In some embodiments, the primers and nucleic acid molecules of the invention are for use in determining the functionality of a Wtk1 gene in a sample.

Methods of Conferring Resistance

By another aspect, there is provided a method of conferring resistance to Pst to a plant cell, the method comprising expressing in the cell at least one of an isolated DNA molecule of the invention, an artificial vector of the invention and a protein of the invention, thereby conferring resistance to Pst to a plant cell. By another aspect, there is provided a method of conferring resistance to Pst to a plant or cell thereof, the method comprising expressing in a cell of the plant at least one of an isolated DNA molecule of the invention, an artificial vector of the invention and a protein of the invention, thereby conferring resistance to Pst to a plant or cell thereof.

In some embodiments, the expressing is in at least 20, 25, 30, 40, 50, 60, 70, 75, 80, 85, 90, 95, 97, 99 or 100% of the cells of the plant. Each possibility represents a separate embodiment of the invention.

By another aspect, there is provided a method of conferring resistance to Pst to a plant cell, the method comprising converting at least one wtk1 non-functional allele of the cell into a functional Wtk1 gene, thereby conferring resistance to Pst to a plant cell.

In some embodiments, the plant cell is not resistant to Pst. In some embodiments, the plant cell does not comprise a functional Wtk1 gene. In some embodiments, the cell comprises a wtk1 non-functional allele. In some embodiments, the cell comprises a wtk1 pseudogene.

In some embodiments, said converting comprises CRISPR genome editing. In some embodiments, said converting comprises targeted mutation of said wtk1 non-functional allele and/or pseudogene. In some embodiments, the functional Wtk1 gene comprises a nucleic acid sequence with at least 99%, 97%, 95%, 90%, 85%, 80%, 75%, or 70% homology or identity to SEQ ID NO:1. Each possibility represents a separate embodiment of the invention. In some embodiments, the functional Wtk1 gene comprises a nucleic acid sequence with at least 99%, 97%, 95%, 90%, 85%, 80%, 75%, or 70% homology or identity to SEQ ID NO:3. Each possibility represents a separate embodiment of the invention. In some embodiments, the functional Wtk1 gene comprises a nucleic acid sequence with at least 99%, 97%, 95%, 90%, 85%, 80%, 75%, or 70% homology or identity to SEQ ID NO: 119. Each possibility represents a separate embodiment of the invention. In some embodiments, the functional Wtk1 gene comprises a nucleic acid sequence that encodes a protein with at least 99%, 95%, 90%, 85%, 80%, 75%, or 70% homology or identity to SEQ ID NO: 2 and confers resistance to Pst. Each possibility represents a separate embodiment of the invention.

By another aspect, there is provided a method of conferring resistance to a pathogen to a plant or cell thereof, the method comprising expressing in a cell of the plant at least one DNA sequence comprising a TKP-containing gene or at least one DNA sequence encoding a TKP-containing protein. In some embodiments, the TKP-containing gene is not a Yr gene. In some embodiments, the TKP-containing gene is not a wheat gene. In some embodiments, the TKP-containing gene is not a barley gene. In some embodiments, the TKP-containing gene is not RPG1. In some embodiments, the TKP-containing gene is not MLOC. In some embodiments, the TKP-containing gene is not a cereal plant gene. In some embodiments, the DNA sequence comprises a homolog or fragment of the TKP-containing gene that confers resistance In some embodiments, the TKP-containing gene is a *T. aestivum* gene. In some embodiments, the TKP-containing gene is a *H. vulgare* gene. In some embodiments, the TKP-containing gene is not a *H. vulgare* gene. In some embodiments, the TKP-containing gene is a *S. cereale* gene. In some embodiments, the TKP-containing gene is a *O. sativa* gene. In some embodiments, the TKP-containing gene is a *Z. mays* gene. In some embodiments, the TKP-containing gene is an *A. thaliana* gene. In some embodiments, the TKP-containing gene is a *P. patens* gene. In some embodiments, the TKP-containing gene is a *S. tuberosum* gene. In some embodiments, the TKP-containing gene is a *B. napus* gene. In some embodiments, the TKP-containing gene is a *P. trichocarpa* gene. In some embodiments, the TKP-containing gene is a *S. bicolor* gene. In some embodiments, the TKP-containing gene is selected from a wheat, barley, rye, rice, maize, thale cress, earth moss, potato, rapeseed, black cottonwood and *Sorghum* gene. In some embodiments, the TKP-containing gene is selected from a wheat, rye, rice, maize, thale cress, earth moss, potato, rapeseed, black cottonwood and *Sorghum* gene. In some embodiments, the TKP-containing gene is a wheat gene. In some embodiments, the TKP-containing gene is a rye gene. In some embodiments, the TKP-containing gene is a rice gene. In some embodiments, the TKP-containing gene is a maize or corn gene. In some embodiments, the TKP-containing gene is a thale cress gene. In some embodiments, the TKP-containing gene is a earth moss gene. In some embodiments, the TKP-containing gene is a potato gene. In some embodiments, the TKP-containing gene is a rapeseed gene. In some embodiments, the TKP-containing gene is a black cottonwood gene. In some embodiments, the TKP-containing gene is a *Sorghum* gene.

Methods of Detection

By another aspect, there is provided a method for detecting a functional Wtk1 gene in a sample, comprising:

a. providing nucleic acids from the sample; and
b. detecting a nucleic acid molecule comprising SEQ ID NO: 1 in the provided nucleic acids, thereby, detecting a functional Wtk1 gene in a sample.

In some embodiments, the detecting comprises:

a. hybridizing at least one nucleic acid molecule of the invention to the provided nucleic acid molecules, wherein the at least one molecule comprises 100% complementarity to SEQ ID NO: 1; and
b. detecting the hybridizing, wherein the presence of the hybridizing indicates the presence of a functional Wtk1 gene in the sample.

By another aspect, there is provided a method for determining functionality of a Wtk1/wtk1 gene in a sample, comprising:

a. amplifying DNA reverse-transcribed from RNA obtained from the sample, with a primer comprising the sequence of SEQ ID NO: 105, a primer comprising the sequence of SEQ ID NO: 106, and a primer comprising the sequence of SEQ ID NO: 107, or with a primer comprising the sequence of SEQ ID NO: 108, a primer comprising the sequence of SEQ ID NO: 109, and a primer comprising the sequence of SEQ ID NO: 110, wherein the primers comprising SEQ ID NO: 105 and SEQ ID NO: 108 comprise a first fluorescent tag and the primers comprising SEQ ID NO: 106 and SEQ ID NO: 109 comprise a second fluorescent tag; and
b. detecting a fluorescent product of the amplifying, wherein the presence of the first fluorescent tag indicates the presence of a functional Wtk1 gene in the sample and the presence of the second fluorescent tag indicates the presence of a non-functional wtk1 gene in the sample.

Detecting a product of amplification is well known in the art and includes but is not limited to gel electrophoreses and column purification. In some embodiments, the one or more primers comprise a tag and the detecting a product of the amplifying comprises detecting the tag. In some embodiments, the tag is a fluorescent tag. In some embodiments, the tag is a FRET tag. Fluorescently-tagged PCR is well known in the art, and detection of the amplification product may be performed with any fluorometer.

In some embodiments, a functional Wtk1 gene comprises the nucleic acid sequence provided in SEQ ID NO: 1. In some embodiments, functional Wtk1 gene comprises the nucleic acid sequence provided in SEQ ID NO: 3. In some embodiments, functional Wtk1 gene comprises the nucleic acid sequence provided in SEQ ID NO: 1 or SEQ ID NO: 3. In some embodiments, the functional Wtk1 gene encodes a protein with two functional kinase domains. In some embodiments, the kinase domains comprise the sequences provided in SEQ ID NO: 4 and SEQ ID NO: 5. In some embodiments, a functional Wtk1 gene encodes a protein that confers resistance to Pst.

In some embodiments, the sample is from a plant. In some embodiments, the plant is a cereal. In some embodiments, the cereal is selected from wheat, barley, oats, triticale and rye. In some embodiments, the cereal is selected from wheat, barley, oats, triticale, rye, rice and maize. In some embodiments, the cereal is wheat. In some embodiments, the plant is any plant that can be infected by Pst.

In some embodiments, the sample is from a leaf of the plant. In some embodiments, the sample is from a mature plant. In some embodiments, the sample is from any one of cultivated plant germplasm, pre-breeding materials, and elite plant cultivars. As used herein, "germplasm" refers to any living tissue from which a new plant can be grown. In some embodiments, the germplasm is a seed. In some embodiments, the germplasm is any one of a seed, a leaf, stem, tissue culture cells, embryoids and pollen. In some embodiments, the germplasm comprises only a few cells. In some embodiments, the germplasm comprises enough material to perform PCR. As used herein, "pre-breeding materials" refers to materials that are not generally directly be used for breeding, but which contain genetic information that can be transferred to breeding materials. As used herein, "cultivars" refers to a plant or group of plants selected for desirable characteristics and maintained by propagation. It will be understood by one skilled in the art, that it is advantageous to those growing cereal plants, to integrate a functional Wtk1 gene into the genomes of their crops. Further, it will be advantageous to integrate it into all of the crop and not just a portion. As such, the grower will need to confirm the presence of the functional gene, potentially at every stage of the transfer of the gene to the crop. The molecules and methods of the invention can be used for this purpose, and thus the methods can be performed at any step of the process of integrating Wtk1 into their crops, and with any material that might be used in this process.

In some embodiments, the provided nucleic acids comprise at least one of genomic DNA, RNA and cDNA reverse-transcribed from RNA from the sample. In some embodiments, the hybridizing comprises at least one of, PCR, southern blotting and northern blotting. One skilled in the art will appreciate that the method of hybridization will be selected to match the source of the provided nucleic acids. As non-limiting examples, PCR may be selected when the nucleic acids are cDNA, southern blotting may be selected when the nucleic acids are genomic DNA and northern blotting may be selected when the nucleic acids are RNA. In some embodiments, the PCR is any one of RT-PCR, qPCR, real-time PCR, or conventional end-point PCR. In some embodiments, detecting the hybridizing comprises detection of a PCR product. In some embodiments, the detecting comprises gel electrophoreses. In some embodiments, the detecting comprises sequencing, deep sequencing or next-generation sequencing.

In some embodiments, the primers are Kompetative Allele Specific PCR (KASP) primers. KASP is a well-known fluorescently tagged PCR amplification assay. It requires three primers, two differential primers, one each for two genes (or alleles) and a third primer that is common to both genes/alleles. In some embodiments, the KASP assay can be multiplexed, with two sets of three primers used at the same time for amplification. In some embodiments, two amplifications are performed separately. In some embodiments, a primer comprising the sequence of SEQ ID NO: 105, a primer comprising the sequence of SEQ ID NO: 106, and a primer comprising the sequence of SEQ ID NO: 107 are used in the method. In some embodiments, a primer comprising the sequence of SEQ ID NO: 108, a primer comprising the sequence of SEQ ID NO: 109, and a primer comprising the sequence of SEQ ID NO: 110 are used in the method. In some embodiments, a primer comprising the sequence of SEQ ID NO: 105, a primer comprising the sequence of SEQ ID NO: 106, a primer comprising the sequence of SEQ ID NO: 107, a primer comprising the sequence of SEQ ID NO: 108, a primer comprising the sequence of SEQ ID NO: 109, and a primer comprising the sequence of SEQ ID NO: 110 are used in the method.

By another aspect, there is provided a method of designing a differential primer for differentiating between Wtk1 and wtk1, the method comprising selecting a primer with 100% complementarity to either Wtk1 or wtk1, and at least one nucleotide that is not complementary to the nucleotide at the same position in the gene for which there is not 100% complementarity. A person skilled in the art will understand that the mores 3' nucleotide of a primer are the most crucial for binding, and thus a single nucleotide polymorphism (SNP) between Wtk1 and wtk1 positioned at the 3' end will confer differential binding. In some embodiments, at least 1, 2, 3, 4, 5, 6, 7, 8, 9, or 10 nucleotides are not complementary to the gene for which the primer does not have 100% complementarity. Each possibility represents a separate embodiment of the invention. In some embodiments, the most 3' nucleotide is not complementary. In some embodiments, at least one of the three most 3' nucleotides are not complementary.

Kits

By another aspect there is provided a kit comprising at least 2 primers selected from a primer comprising the sequence of SEQ ID NO: 105, a primer comprising the sequence of SEQ ID NO: 106, and a primer comprising the sequence of SEQ ID NO: 107, and/or at least 2 primers selected from a primer comprising the sequence of SEQ ID NO: 108, with a primer comprising the sequence of SEQ ID NO: 109, and a primer comprising the sequence of SEQ ID NO: 110.

By another aspect there is provided a kit comprising at least 2 primers, wherein the primers comprise a sequence selected from SEQ ID NOs: 69-70 and 103-110.

In some embodiments, the kit comprises a primer comprising the sequence of SEQ ID NO: 105, and a primer comprising the sequence of SEQ ID NO: 107 and optionally a primer comprising the sequence of SEQ ID NO: 106. In some embodiments, the kit comprises a primer comprising the sequence of SEQ ID NO: 108, and a primer comprising the sequence of SEQ ID NO: 110 and optionally a primer comprising the sequence of SEQ ID NO: 109.

In some embodiments, at least one primer of the kit comprises a tag. In some embodiments, the differential primers of the kit comprise a tag. In some embodiments, the tag is selected from a fluorescent tag, a chemiluminescent tag, a colored dye tag, a radioactive tag, and a protein including an enzyme, a peptide or a ligand. In some embodiments, the tag is a FRET tag. In some embodiments, the primers are KASP primers.

In some embodiments, the kits of the invention are for use in determining the functionality of a Wtk1/wtk1 gene in a sample. In some embodiments, the kits of the invention are for use in detecting a functional Wtk1 gene or a non-functional wtk1 gene in a sample.

As used herein, the term "about" when combined with a value refers to plus and minus 10% of the reference value.

For example, a length of about 1000 nanometers (nm) refers to a length of 1000 nm+−100 nm.

It is noted that as used herein and in the appended claims, the singular forms "a," "an," and "the" include plural referents unless the context clearly dictates otherwise. Thus, for example, reference to "a polynucleotide" includes a plurality of such polynucleotides and reference to "the polypeptide" includes reference to one or more polypeptides and equivalents thereof known to those skilled in the art, and so forth. It is further noted that the claims may be drafted to exclude any optional element. As such, this statement is intended to serve as antecedent basis for use of such exclusive terminology as "solely," "only" and the like in connection with the recitation of claim elements, or use of a "negative" limitation.

In those instances where a convention analogous to "at least one of A, B, and C, etc." is used, in general such a construction is intended in the sense one having skill in the art would understand the convention (e.g., "a system having at least one of A, B, and C" would include but not be limited to systems that have A alone, B alone, C alone, A and B together, A and C together, B and C together, and/or A, B, and C together, etc.). It will be further understood by those within the art that virtually any disjunctive word and/or phrase presenting two or more alternative terms, whether in the description, claims, or drawings, should be understood to contemplate the possibilities of including one of the terms, either of the terms, or both terms. For example, the phrase "A or B" will be understood to include the possibilities of "A" or "B" or "A and B."

It is appreciated that certain features of the invention, which are, for clarity, described in the context of separate embodiments, may also be provided in combination in a single embodiment. Conversely, various features of the invention, which are, for brevity, described in the context of a single embodiment, may also be provided separately or in any suitable sub-combination. All combinations of the embodiments pertaining to the invention are specifically embraced by the present invention and are disclosed herein just as if each and every combination was individually and explicitly disclosed. In addition, all sub-combinations of the various embodiments and elements thereof are also specifically embraced by the present invention and are disclosed herein just as if each and every such sub-combination was individually and explicitly disclosed herein.

Additional objects, advantages, and novel features of the present invention will become apparent to one ordinarily skilled in the art upon examination of the following examples, which are not intended to be limiting. Additionally, each of the various embodiments and aspects of the present invention as delineated hereinabove and as claimed in the claims section below finds experimental support in the following examples.

Various embodiments and aspects of the present invention as delineated hereinabove and as claimed in the claims section below find experimental support in the following examples.

EXAMPLES

Generally, the nomenclature used herein and the laboratory procedures utilized in the present invention include molecular, biochemical, microbiological, and recombinant DNA techniques. Such techniques are thoroughly explained in the literature. See, for example, "Molecular Cloning: A laboratory Manual" Sambrook et al., (1989); "Current Protocols in Molecular Biology" Volumes I-III Ausubel, R. M., ed. (1994); Ausubel et al., "Current Protocols in Molecular Biology", John Wiley and Sons, Baltimore, Md. (1989); Perbal, "A Practical Guide to Molecular Cloning", John Wiley & Sons, New York (1988); Watson et al., "Recombinant DNA", Scientific American Books, New York; Birren et al. (eds) "Genome Analysis: A Laboratory Manual Series", Vols. 1-4, Cold Spring Harbor Laboratory Press, New York (1998); methodologies as set forth in U.S. Pat. Nos. 4,666,828; 4,683,202; 4,801,531; 5,192,659 and 5,272,057; "Cell Biology: A Laboratory Handbook", Volumes I-III Cellis, J. E., ed. (1994 Mishell and Shiigi (eds)), "Strategies for Protein Purification and Characterization—A Laboratory Course Manual" CSHL Press (1996); all of which are incorporated by reference. Other general references are provided throughout this document.

Materials and Methods

Plant Materials

A large $F_2$ mapping population was developed by crossing the susceptible *durum* wheat (*Triticum turgidum* L ssp. *durum*) accession D447 (LD393/2*Langdon ND58-322) as the female parent with the resistant either $BC_3F_9$(B9) or $BC_3F_{10}$ (B10) introgression line, which carry the Yr15 gene within a 1BS chromosome segment introgressed from wild emmer wheat [*T. turgidum* L ssp. *dicoccoides* (DIC)], accession G25 (G25), as the male parent. A collection of Yr15 introgression lines (IL), representing a wide range of *durum* wheat (tetraploid) and common wheat (hexaploid) varieties, was used in the current study (Table 12). In addition, the following Yr5/Yr15 ILs, which were developed by J. Dubcovsky and represent an example for pyramiding of resistance genes, were challenged with several stripe rust [*Puccinia striiformis* f sp. *tritici* (Pst)] races (pedigrees in parentheses): YecoraRojoYr5Yr15 (Ciano 67//Sonora 64/Klein Rendidor/3/II-8156=1123584), PatwinYr5Yr15 (Madsen/2*Express), SummitYr5Yr15 (Express//Tadorna/PB775), DirkwinYr5Yr15 (Twin/Triple Dirk). The Yr15 gene knockout mutagenized lines were developed by ethyl methane sulphonate (EMS) treatment of the tetraploid IL B9, and the hexaploid ILs Avocet+Yr15, Excalibur+Yr15, and Suncea+Yr15. The hexaploid common wheat variety 'Fielder' and the tetraploid *durum* wheat 'Kronos', which are susceptible to Israeli Pst isolate #5006 (race 38E134; 16) and U.S. Pst race PST-130 (17) were used for the transgenic complementation experiment. The *Triticum* accessions evaluated for the distribution of Yr15 alleles were kindly provided by the Centre for Genetic Resources (CNG; Wageningen University & Research, Wageningen, The Netherlands), and by the USDA National Small Grain Collection (NSGC; USDA, Aberdeen, Id., USA). The DIC accessions that were collected from a broad range of natural habitats in the Fertile Crescent are maintained at the Wild Cereal Gene Bank of the Institute of Evolution, University of Haifa (Haifa, Israel).

Stripe Rust Assays and Plant Growth Conditions

Phenotyping of recombinant, mutant and transgenic lines under growth chamber conditions was carried out in Haifa University and UC Davis according to the following protocol: urediniospores used for inoculation of leaf tissue were first suspended in Soltrol® 170 light oil (Chevron Phillips Chemical Company, The Woodlands, Tex.) and then sprayed using a TLC spray tube (Kontex, Blomberg, Germany). Inoculated plants were first placed in a dew chamber (100% humidity) at 10° C. for 16 h in the dark followed by 8 h of light. The plants were then transferred to a growth chamber (70% humidity) under the following day/night regime: 16 h at 15° C. with a light intensity of 150 µmol m−2 s−1 followed by 8 h at 10° C. in darkness. Plants were inoculated either at the two- to four-leaf stage ("seedling inoculation") or at the stem elongation stage ("adult-plant inoculation"). The rust severity was evaluated and characterized 14 to 18 days after inoculation using a 0 to 9 scale of infection type (IT).

In the Global Rust Reference Centre (GRRC; Aarhus University, Denmark) Yr15 and Yr5 introgression lines were phenotyped for their response to the Pst isolates DK92/02 and AU85569 (FIG. 12) from the isolate collection of the GRRC. Plants were then point inoculated. In brief, plants were grown 16 days in greenhouse until the second leaf of all wheat differential lines was fully emerged. Second leaf was fixed on to acrylic pedestals and inoculated with 5 µl of urediniospores suspended in engineered fluid (Novec™ 7100, 3M, USA) at a concentration of 5 mg/ml, one isolate per leaf. All combinations of isolate and wheat differential line were replicated at least twice. After incubation in darkness for 24 h at 10° C., the leaves were released from the pedestals and pots were placed in the greenhouse with alternating periods of 16 h light at 17° C. and 8 h darkness at 12° C. Infection type using the 0 to 9 scale was scored 18 days after inoculation, and photos of each interaction phenotype were taken with a Canon EOS 7D digital SLR equipped with a Canon macro lens EF 100 mm f/2.8L IS USM (Canon, Japan).

Microscopy of Pst-Wheat Interactions within Infected Leaf Tissues

Fluorescence microscopy of *P. striiformis* structures was performed. Wheat germ agglutinin (WGA; a lectin that binds specifically to β (1→4)-N-acetyl-D-glucosamine, i.e., chitin) conjugated with a fluorescent dye was used to visualize the intercellular growth and pustule formation on infected leaves. Leaf segments ($2^{nd}$ leaf, 10 cm long) from the near isogenic lines (NILs), Avocet S and Avocet+Yr15, each of which had been inoculated with urediniospores of Pst race #5006, were sampled from 1 until 11 day post inoculation (dpi) (10:00 to 10:30 am, every two days), when visible sporulation developed on the susceptible plants. The progress in visible response to Pst inoculation 1 to 14 dpi in the susceptible and the resistant lines is presented in FIG. 13I.

The sampled leaf segments were cleared with KOH at 37° C. for 24 h and washed twice with Tris-HCl (pH 7.5) for neutralization. Then, a solution of WGA conjugated to fluorophore Alexa 488 (L4895-2MG; Sigma-Aldrich) was placed on the leaf surfaces and stained for 24 h at 4° C. After washing with $ddH_2O$, the stained leaf tissues were gently placed on microscope slides, immersed with antifade mounting medium for fluorescence (Vectashield, Vector Laboratories), covered with a cover glass, sealed with rubber cement, and stored at 4° C. in the dark. Fluorescent microscopy was carried out on an inverted fluorescent microscope, Leica DMi8 (Leica Microsystems, Wetzlar, Germany) fitted with a filter cube for the FITC excitation range (EX: 460-500, DC: 505, EM: 512-542) and a FLUO regime to observe the WGA-stained fungal structures. The resultant micrographs are presented in FIG. 13A-13G.

Relative Quantification of Fungal Biomass within Infected Leaf Tissues

After inoculation with Pst isolate #5006 leaf segments (middle, 2nd leaf) of the resistant Avocet+Yr15 and susceptible Avocet S NILs were cut every two days (1-14 dpi), and 10 biological replicates collected for each line at each time point. Quantification of fungal biomass by chitin measurement was conducted. Leaf segments were weighed and autoclaved in KOH solution, then washed with Tris-HCl (pH 7.0) to neutralize pH. Leaf tissues were then transferred to microcentrifuge tubes that contained 1 ml of Tris-HCl solution for each 200 mg of fresh leaf tissue, according to weights determined at harvest time. Leaf samples were homogenized in a TissueLyser II (Qiagen) and an aliquot of each sample suspension was transferred to a microcentrifuge tube containing WGA conjugated to fluorophore Alexa 488 (L4895-2MG; Sigma-Aldrich) dissolved in water. Three technical replicates were made for each tissue sample. Samples were mixed by repetitive pipetting and incubated for 60 min at room temperature. After staining, samples were centrifuged at 600×g for 3 min. The supernatant was removed by pipetting and the pellet washed three times and resuspended in Tris-HCl, and then transferred into black, 96-well microtiter fluorometric trays. Fluorescence was measured on a SpectraMax M2e Microplate Reader (Molecular Devices, Sunnyvale, Calif., USA) with five seconds of shaking before first read, 485-nm excitation and 535-nm emission wavelengths, a 1.0 s measurement time, and a cross pattern of well scanning yielding an average measurement per well. Statistical analyses of parameters associated with the accumulation of fungal biomass were made by the maximal likelihood estimation (MLE) method (SPSS) following the logistic growth model. The null hypothesis, for: no growth was tested by the likelihood ratio test. The results are presented in FIG. 13H.

Development of a High-Density Genetic Map

A primary genetic map of Yr15 was developed using simple sequence repeat (SSR) markers that had been assigned to chromosome arm 1BS. These SSR markers, suitable for marker-assisted selection (MAS) of Yr15, were used in the current study for screening a large $F_2$ mapping population for lines containing recombinations between the closest flanking SSR markers, enabling assignment of Yr15 to deletion bin Sat0.31 of chromosome arm 1BS. Thereafter, a dominant marker and two cleaved amplified polymorphic sequence (CAPS) markers were developed as described by Raats et al., based on expressed sequence tags (ESTs) assigned by Peng et al. to 1BS deletion bin Sat0.31 (Table 1). These markers were tested on the *T. aestivum* cv. Chinese Spring (CS) deletion lines 1AS-1, 1BS-4, and 1BS-9, which were produced by Endo and Gill. B-genome-specific primers were used to amplify marker alleles of the D447, B9, and B10 lines in order to mine polymorphisms, which were exploited for the development of informative PCR markers. The genetic map of the Sat0.31 region that contains Yr15 was further refined by the GenomeZipper approach using synteny with the orthologous regions of Brachypodium distachyon, *Oryza sativa*, *Sorghum bicolor* (Table 3). With this approach, eight markers were developed and the Yr15 region thereby narrowed down to a 0.3 cM interval between the nearest Yr15 flanking markers, uhw264 and uhw259 (FIG. 1).

For development of Kompetitive Allele Specific PCR (KASP) markers, B9 and D447 parental lines were genotyped using the 15K wheat single-nucleotide polymorphism (SNP) array (Trait Genetics GmbH, Gatersleben, Germany). Polymorphic markers, residing on chromosome arm 1BS between the SSR markers barc8 and gwm273 that flank Yr15, were identified from their location on the consensus tetraploid wheat genetic map. Sequences of two SNP markers, RAC875_c826_839 and BS00022902_51, were converted to KASP markers using the Polymarker pipeline (Table 2).

A total of 8573 F2 plants from the D447×B9 or D447× B10 crosses were screened for recombination events in the Yr15 gene region. Three marker sets flanking Yr15 region were used for screening: (i) the SSR markers wmc406 and gwm273, flanking a 13.3 cM interval; (ii) the KAPS markers RAC875_c826_839 and BS00022902_51, flanking a 1.3 cM interval (Fig. S6); (iii) the length polymorphism marker uhw264 and the CAPS marker uhw259, flanking a 0.3 cM interval (FIG. 2). The genetic distances between these sets of markers were calculated by constructing a genetic map using genotyping data collected from 302 F2 plants (FIG. 2, left most panel). A total of 94 homozygous recombinant inbred lines (RILs), which represented 13 independent recombination events, were detected and used for further fine mapping and chromosome walking. These RILs were evaluated for the resistance to Pst isolate #5006. Genotypes and phenotypes of the 13 RILs, which represent the critical recombination events that were detected within the 0.3 cM interval that harbors Yr15 and is delimited by markers uhw264 and uhw259, are presented in Table 5.

Assembly of Physical Maps of the Yr15 Region on Chromosome Arm 1BS

Assembly of a Physical Map Based on Gridded CS and 1BS-Specific CS BAC Libraries Markers uhw264 and uhw259, which flank Yr15, were used to screen a gridded CS BAC library for clones corresponding to the Yr15 region. Three positive BAC clones (TaaCsp364011, TaaCsp1023G2 and TaaCsp1158K20) were picked with marker uhw264 and two (TaaCsp729H14 and TaaCsp814G12) with uhw259 (FIG. 2). The BAC-end sequence (BES) of clone TaaCsp364011 was used to develop marker uhw267. Screening of the CS library with uhw267 yielded clone TaaCsp691F7. The BES of clone TaaCsp729H14 was used to develop marker uhw268, which was mapped distal to uhw259 (FIG. 2). The gap in the physical map of the region in CS corresponding to Yr15 was bridged after a complete 1BS physical map was generated by the construction of a CS 1BS-specific BAC library developed by our group as part of the efforts of the International Wheat Genome Sequencing Consortium (IWGSC) to develop a wheat reference genome sequence. The contigs of the CS1BS physical map were assembled based on DNA fingerprint data using the LTC software developed by our group, as described by Raats et al. Screening of the 57 three-dimensionally arrayed (3-D) BAC pools that comprise the minimal tiling path (MTP, 6,447 clones altogether) of the 1BS specific library with markers Xuhw264, uhw267, uhw268, and uhw259 identified a 1.3 Mb contig that spans the entire region in CS that corresponds to the Yr15 region (ctg49, FIG. 2). The 21 BAC clones (FIG. 2) that bridged the gap between markers uhw267 and uhw268 were identified and sequenced. Molecular markers developed from sequenced clones of the 1BS contigs yielded the genetic markers uhw297 and uhw292, which are distal to Yr15, uhw296 and uhw276 co-segregating with Yr15, and uhw273, uhw275, uhw291, uhw274, uhw282, uhw284, uhw277, uhw268, as well as physical markers uhw280 and uhw279, located proximal to Yr15 (Table 5, FIG. 2). The names and order of the 21 BAC clones are shown in FIG. 2.

Physical Mapping and Sequencing of the Yr15 Region in DIC

The Yr15 donor line, G25, was used for construction of a pooled BAC library. High molecular weight genomic DNA was partially digested with Hind III to obtain fragment sizes in the range of 100-250 kb, which were ligated into a pINDIGO vector (Caltech, Pasadena, Calif., USA), and transformed into *Escherichia coli* cells. After growing individual *E. coli* colonies on agar plates, 443,880 transformed colonies were collected into 150 pools with an average of 2959 colonies per pool. The genome coverage of the G25 BAC library was calculated as 4.5× (average clone size 120 kb). From initial screening of the library with marker uhw280, BAC clone G25-64 was isolated and sequenced. Based on these sequences proximal markers uhw288, uhw289, uhw287, uhw285, uhw286, and uhw281 were developed (Table 4). Further screening of G25 BAC library with the closest distal markers uhw297 and uhw292, the co-segregating marker uhw296, and the proximal marker uhw273, yielded six BAC clones (G25-33, G25-86, G25-40, G25-141, G25-35 and G25-25; FIG. 3). DNA samples of these BACs were extracted using a QIAGEN Plasmid Midi Kit or QIAGEN large-construct kit (Qiagen, Hilden, Germany). Contiguous sequences were generated on a Pacbio RS II instrument (Pacific Biosciences) at the Institute of Biotechnology, University of Helsinki (Finland). BAC clones were sequenced and assembled (HGAP3 implemented in SMRT portal 2.3) separately. The GAP4 program (Staden package) was used to edit and join the assembled BAC contigs into two contigs (G25ctg1, 286,738-bp; and G25ctg2, 131,485-bp), spanning the Yr15 gene region (FIG. 2). Three additional markers, for Yr15, respectively distal (uhw300) or co-segregating (uhw302 and uhw301), were generated by the comparison of G25 sequences with the 1BS pseudomolecule of DIC accession Zavitan (Zavitan) (Tables 6 and 8).

Annotation of the G25 Contigs Containing the Yr15 Region and Identification of the Candidate Gene As a first step prior to gene annotation, repetitive elements within the G25 BAC sequences were masked using the Triticeae Repeat Sequence Database (TREP; http://botserv2.uzh.ch/kelldata/trep-db/index.html). Then, the non-repetitive sequences were analyzed for genes by BLASTN searches against the TIGR Wheat Genome Database (http://tigrblast.tigr.org/euk-blast/index.cgi?project=tael), using the gene prediction software Genscan (http://genes.mit.edu/GENSCAN.html) and FGENESH (http://www.softberry.com/berry.phtml).

A blast search of sequences of the G25ctg1 and G25ctg2 contigs against the high confidence (HC) gene models of 1BS pseudomolecule of Zavitan revealed the presence of three putative HC genes that reside between the markers closest to Yr15. However, only one of them contained predicted protein domains that have been previously associated with plant responses to pathogens. This candidate gene, which has two different kinase-like domains arranged in tandem was designated as WHEAT TANDEM KINASE 1 (Wtk1) and was selected first for further validation (FIG. 3).

Isolation and Sequencing of the Full-Length WTK1 cDNA

Total RNA was extracted using the TRIzol reagent (Invitrogen, Carlsbad, Calif., USA) and poly (A)+ RNA was purified from the total RNA with a Qligotex mRNA Midi Kit (Qiagen). First-strand cDNA was synthesized with Superscript II (Invitrogen) using primer E1820 (Table 11). Nested PCR was carried out first with E1820 and the Yr15 5'UTR primer Y15F0 and then with E2146 (matching part of E1820, Table 11) and the 5'UTR primer Y15F2. The PCR products were purified, cloned and sequenced.

Determination of WTK1 Transcript Start Sites

To determine the start site of the WTK1 transcript, we used 5' RACE. In brief, the poly (A)+ RNA was treated with tobacco acid pyrophosphatase (TAP, Epicentre, USA), then purified with an RNeasy Plant Mini Kit (Qiagen). An adapter (RNAoligo, Table 12) was ligated to the 5' end of the RNA and reverse transcription carried out as above, priming with E1820. Amplification of the 5' end was carried out by two rounds of PCR reactions, using primer 5'RACE (Table 11) and sequentially two gene-specific primers, Y15R2 and Y15R1 (Table 11).

Validation of the Candidate Gene WTK1 by Loss-of-Function: Screening and Characterization of the EMS Mutagenized Lines EMS treatment was conducted. Seeds of the Yr15 tetraploid (B9) and hexaploid (Avocet+Yr15, Excalibur+Yr15, and Suncea+Yr15) introgression lines were treated with 0.4-0.75% EMS solution for 16-18 h at room temperature. Prior to sowing, the seeds were washed three times with 10% sodium thiosulfate and then twice in water (30 min each time), covered with Whatman paper and air-dried at 4° C.

EMS-treated M1 plants were grown in the experimental fields of the Institute of Evolution, University of Haifa, Israel or at the Plant Breeding Institute, University of Sydney, Cobbitty, Australia. Their spikes were covered with envelopes to avoid cross-pollination. A total of 1002 hexaploid and 2112 tetraploid M2 families (10-20 seeds per family) were first screened for resistance to stripe rust under field conditions in Israel (with Pst isolate #5006) or in Australia (with Pst isolate 110 E143A+). All M3 seedlings obtained from susceptible M2 plants were inoculated in a growth chamber with Pst isolate #5006 to confirm homozygosity of the recessive mutations. In total, 10 mutagenized lines were obtained at the M2 generation and validated at M3, as shown in FIG. 4B.

The susceptible plants from the EMS-treated M2 families were screened for mutations within the coding sequence of the Yr15 candidate gene Wtk1, using three gene-specific primers (Table 11). Amplified products were sequenced and compared for nucleotide variations by multiple sequence alignment. Furthermore, two overlapping primer pairs (WTK1_L2F and WTK_RE6, Table 11) designed along the coding sequence of the Wtk1 were used to amplify the full-length cDNA from the susceptible M2 plants and PCR products were sequenced to confirm the detected point mutations. The Wtk1 mutations were ranked using the program Sorting Intolerant From Tolerant (SIFT) to predict the effects of non-synonymous mutations on protein function (Table 7). The independence of 10 mutagenized lines was confirmed, as detailed in Table 7.

We crossed two of the EMS-mutagenized lines of common wheat (EMS4 and EMS6, Table 7) with the resistant wild-type parental line Avocet+Yr15 to produce segregating F2 families. The response of each F2 population to stripe rust was assessed at the seedling stage, and a Chi-squared test used to evaluate the goodness of fit for the observed and expected ratios in that population (Table 8). DNA was isolated from 40 F2 plants and sequence analysis was used to confirm co-segregation of homozygosity for the mutations in Wtk1 with the loss of resistance to Pst.

Validation of the Candidate Gene WTK1 by Gain-of-Function Complementation

*Agrobacterium tumefaciens*-mediated transformation of susceptible *durum* and common wheat varieties, respectively Kronos and Fielder, served to further verify WTK1 function by complementation.

Phusion® High-Fidelity DNA Polymerase (New England BioLabs, USA) was used to amplify the WTK1 genomic region from G25 BAC clone G25-141 (FIG. 3). Restriction sites XhoI and AvrII were added respectively to primers Yr15F1/R1 and Yr15F2/R2 (Table 11) to enable cloning into the pLC41Hm transformation vector. Two overlapping PCR products were digested by restriction enzymes XhoI-MscI and MscI-AvrII, purified from agarose gel bands, and cloned into XhoI-SpeI linearized pLC41Hm. In this way, a 9116-bp genomic fragment that contains the full-length Wtk1 coding region, the 3428 bp immediately upstream having the native promoter, as well as the 1031 bp immediately downstream, was prepared for transformation. Sanger sequencing confirmed the accuracy of the construct. *A. tumefaciens*-mediated transformation of Kronos and Fielder with this construct was carried out at the University of California Plant Transformation Facility in Davis (http://ucdptf.ucdavis.edu/).

In total, 15 independent T0 plants in Kronos (Tyr15-K1 to Tyr15-K15) and seven T0 plants in Fielder (Tyr15-F1 to Tyr15-F7) were obtained. Three primer pairs (HpyF1/R1, Yr15TestF1/R1 and Y15K1_F2/Yr15P2; Table 11) were used to validate the presence of WTK1 in the transgenic plants. In addition, we extracted mRNA from all T0 plants and estimated the transcript levels of the three Wtk1 isoforms (Main isoform, Isoform2 and Isoform3) by qRT-PCR using Ubiquitin as the endogenous control. The transcript levels of Wtk1 in all T0 events in Kronos and Fielder and in non-transgenic controls are shown in FIG. 4D-4E. Wtk1 transcripts were detected in most of T0 transgenic plants, except for three Kronos (Tyr15-K1, Tyr15-K6 and Tyr15-K9), and two Fielder (Tyr15-F3 and Tyr15-F7) putative transformants (FIG. 4D-4E).

We germinated 10-25 T1 seeds from each transgenic event that expressed WTK1 and inoculated the plants with Pst race PST-130, which is virulent on Kronos and Fielder. All 12 positive T1 families in Kronos and the five positive T1 families in Fielder showed resistance to this Pst race. We genotyped all tested T1 plants and confirmed co-segregation of the resistance with the presence of the transgene. Five representative susceptible T1 plants which did not carry the transgene and five resistant T1 plants with the transgene are presented in FIG. 41H-4I. Transcript levels of the three isoforms of Wtk1 in five susceptible and 15 resistant plants from family Tyr15-F1, which was inoculated with PST-130, are shown in FIG. 4F.

Furthermore, 5-10 independent plants each of the T2 families from transgenic events Tyr15-F1, Tyr15-F4, Tyr15-F5, Tyr15-F6, Tyr15-K7, Tyr15-K8, Tyr15-K10O, Tyr15-K12, and Tyr15-K15 were also tested with Pst isolate #5006, which is likewise virulent on Kronos and Fielder. All five T2 positive families in Kronos and the four positive T2 families in Fielder showed the resistance phenotype (FIG. 4J).

Gene Expression Analysis by the Quantitative Reverse Transcription PCR (qRT-PCR)

Expression analysis was conducted. Total RNA was isolated from various plant tissues (leaves, roots, and stems) using an RNeasy Plant Mini Kit (Qiagen, USA). First-strand cDNA was generated using the qScript™ Flex cDNA Synthesis Kit (Quanta Biosciences, USA). A Wtk1 expression survey in leaves, roots, and stems was conducted by RT-PCR with Ubiquitin as the endogenous control. The qRT-PCR was performed on a StepOne Plus Real-Time PCR system (Applied Biosystems, USA) using the following program: 95° C. for 20 s; 40 cycles of 95° C. for 3 s, and 60° C. for 30 s. The qRT-PCR reaction mixture contained the following components in a total volume of 10 µl: 5 µl Fast SYBR green master mix (Applied Biosystems); 2.5 µl diluted cDNA; 300 nM of each primer. The efficiency of each pair of primers was calculated using four 5-fold dilutions (1:1, 1:5, 1:25, and 1:125) in triplicates. Amplification efficiencies were higher than 95%. Transcript levels are expressed as linearized fold-Ubiquitin levels calculated by the formula 2 (Ubiquitin CT−Target CT)±standard error of the mean (SEM).

Alternative Splicing of WTK1 mRNA

Sequencing of 48 B9 cDNA clones, which were amplified with a poly(T) primer and Wtk1-specific primers, or Wtk1-specific primers alone revealed three alternative splicing variants (Main isoform, Isoform2, Isoform3, FIG. 5). The Main transcript variant includes the complete Wtk1 coding sequences, whereas the Isoform2 and Isoform3 variants result from alternative splicing and encode proteins with truncated kinase domains.

To determine the relative transcript levels of these three splicing variants, we designed WTK1 isoform-specific PCR primers for each one of them (Table 11). These primers served to amplify the three variants from leaves of B9, which were collected after the following treatments: (i) before inoculation (0 h), as the control; (ii) after inoculation with spores of Pst isolate #5006 suspended in Soltrol® 170 light oil; (iii) a mock control, comprising plants sprayed with Soltrol® 170 light oil without Pst spores. Samples of treatments (ii) and (iii) were collected at 1, 3, 5, 7, and 9 days post-inoculation (dpi), with 6 biological replicates for each treatment at each time point. All data were subjected to statistical analysis using the general linear model with SPSS software. The expression results are presented in FIG. 6B, and FIG. 4D-4F.

Subcellular Localization of the WTK1 Protein

Plant Growth, Protoplast Isolation and Transformation

Barley protoplasts were isolated from *Hordeum vulgare* cv. Bomi plants. Protoplasts (8×105) were electroporated with 20-40 μg DNA at 300 V/cm essentially as is known in the art, diluted into Gamborg's B-5 Basal Medium with minimal organics that contained 10% glucose, and then transferred into a glass-bottomed 35 mm microwell dish (MatTek Corporation, USA) for microscopy observations.

Microscopy

Electroporated protoplasts were cultured overnight at 22° C. before imaging under an inverted confocal laser scanning microscope (Leica TCS SP5 II, Leica Microsystems) with a 63×water immersion objective. The following light ranges were used: GFP (ex 488 nm, em 500-543 nm); DAPI (ex 405 nm, em 430-550 nm); chlorophyll autofluorescence (ex 488 nm, em 673-725 nm). The results are presented in FIG. 8A-8I.

DNA Constructs

A WTK1 cDNA clone was prepared as described in Section 8 (Isolation and sequencing of full-length WTK1 cDNA). All expression vectors were created with a Multisite Gateway Three-Fragment Vector Construction Kit (Invitrogen). The 5' entry clone was prepared by the BP reaction between pDONRP4-P1R and a 35S promoter fragment amplified from pBI221 (GenBank accession AF502128.1) using primers attB4F35S and attB1R35S (Table 11). The entry clone for the full-length WTK1 was created by carrying out the BP reaction between pDONR221 and the PCR product amplified from the WTK1 cDNA clone with primers attB1FKinase and attB2RYr15 (Table 12). The entry clone for the N-terminal and C-terminal kinase-like domains were similarly prepared using primers attB1FKinase and attB2Rkinase, and attB1Freg and attB2RYr15 (Table 11), respectively. The 3'-entry clone was prepared by carrying out the BP reaction with pDONRP2RP3 and a GFPnos fragment amplified from pVEC8_GFP (GenBank: FJ949107.1) by PCR using primers attB2FGFPnos and attB3RGFPnos (Table 11). The final clones used for transient transformation and expression in protoplasts were created by the LR reaction between the respective entry clones and the destination vector pDESTR4-R3 according to the instructions of the Gateway kit.

Analysis of WTK1 Kinase-Like Domains

A BLASTP search of the NCBI non-redundant protein database was used to assign WTK1 kinase-like domains to specific kinase superfamily and to search for sequences of proteins similar to WTK1.

Multiple alignment of WTK1 kinase domains with 23 different plant kinase domains was performed using Clustal Omega with default parameters. In this analysis, we included the four closest kinases identified by BLASTP (WKS1, PTO and two WAK5), two kinase domains of RPG1, two kinase domains of *H. vulgare* MLOC_38442.1 and 15 kinase domains from known and putative plant pattern recognition receptors (PRRs), of which 14 are non-RD kinases and one is an RD-kinase (FIG. 7). A BLASTP was used also to estimate a similarity of WTK1 to RPG1 and MLOC_38442.1 since all of them contain two kinases organized in tandem. A phylogenetic tree was computed with RaxML and drawn with iTOL to visualize the relationships between the different groups of kinases (FIG. 9).

Evolutionary History of WTK1 Orthologs and Paralogs in Wheat and Other Cereal Species The following sequence databases were used for searching and extracting WTK1 protein sequences, used for phylogenetic analysis:

a) Genome assembly of wild emmer wheat (Zavitan pseudomolecules);
b) Genome assembly of common wheat (CS pseudomolecules);
c) Genome assembly of barley *H. vulgare* (Morex pseudomolecules);
d) Genome assembly of *A. speltoides* (accession #29; https://wheat-urgi.versailles.inra.fr/Seq-Repository/Assemblies);
e) Genome assembly of *A. tauschii;*
f) Genome assembly of *T. urartu;*
g) Genome assembly of rye *S. cereale;*
h) The public resource eggNOG version 4.5 was searched for WTK1 Orthologous Group (OG) of proteins at different taxonomic levels. The resulted group of WTK1 orthologs, designated as ENOG4115QHQ, included 11 protein sequences belonging to nine different species. Two of these proteins were used for further phylogenetic analysis (*B. distachyon* BRADI2G38370.1 and *O. sativa* LOC_Os01g20880.1).

In total, we have selected for analysis 21 protein sequences; all sequence positions that contained gaps and missing data, as compared with WTK1 from G25 1BS, were eliminated from analysis. Therefore, the analysis was conducted using 263 amino acid residues out of 665 of the full length of WTK1 from G25 1BS. The evolutionary history of WTK1 was inferred using the Neighbor-Joining algorithm based on evolutionary distances computed using the Poisson correction method. The quality of the derived phylogeny of WTK1 was assayed using bootstrap test with 10,000 replicates. The analysis was performed with MEGA7 software. The obtained results are presented in FIG. 10.

Distribution of the WTK1 Gene Among Various Triticeae Species.

Plant Materials

DIC accessions (Table 9) were obtained from the National Small Grains collection (NSGC; USDA, Aberdeen, Id., USA; PI numbers), the Wild Cereal Gene Bank (WCGB; Institute of Evolution, University of Haifa, Haifa, Israel; TD numbers), the International Center for Agricultural Research in Dry Areas (ICARDA; Rabat, Morocco; IG numbers), the Center for Genetic Resources (CGN; Wageningen University & Research, Wageningen, The Netherlands; CGN numbers). Germplasm samples of other Triticeae species (Table 10) were provided by CGN and NSGC. Durum and common wheat accessions (Table 12) were obtained either from Salamini, the University of California (Davis), or the University of Haifa collections of Yr15 introgression lines.

Marker Design for Testing the Distribution of WTK1

A set of four gene-specific, diagnostic markers was used to test the distribution of WTK1, two for kinase-like domain I (KinI) and two for kinase-like domain II (KinII) (Table 11). Dominant PCR markers were designed to identify the presence of the Wtk1 functional allele, amplifying a 1 kb PCR product for KinI and 2 kb for KinII.

Co-dominant KASP markers that can differentiate between the functional Wtk1 and the non-functional wtk1 alleles (Table 9) were designed using the sequence of Wtk1 from G25 and those of wtk1 from CS and Zavitan. Alignment of all WTK1 sequences was made with the BioEdit software. The positions of the SNPs in the coding regions of KinI and KinII that differentiate between Wtk1 and wtk1 sequences were determined and served in the design of the forward A and B KASP primers. The reverse common primer (C) was designed at the NCBI/Primer-BLAST website (https://www.ncbi.nlm.nih.gov).

Classification of the WTK1 Kinase-Like Domains

A BLASTP search of the NCBI non-redundant protein database revealed that both WTK1 kinase-like domains belong to the superfamily of protein kinase catalytic domains. KinI, which is derived from the first exon of WTK1 (residues 42-310), contains all 11 conserved subdomains of a protein kinase. The nearly invariant residues of WTK1 KinI subdomain I (Gly-X-Gly-X-X-Gly) and subdomain VIII (Ala, Phe and Gly, Fig. S14) are all conserved; nevertheless, in subdomain VI, KinI has Gly residue instead of Arg adjacent to Asp. Thus, it is classified as a non-RD kinase (Fig. S14). Moreover, the conserved residues found in KinI subdomains VI and VIII classify it as a protein-serine/threonine kinase (FIG. 7). KinII of WTK1 is encoded in the second to the sixth exon (residues 359-665, FIG. 3). WTK1 KinII also contains the 11 kinase subdomains that place it within the superfamily of protein kinase catalytic domains. However, it is difficult to classify WTK1 KinII as an RD or non-RD kinase since it has an Asn residue in the position of the catalytic Asp in subdomain VI, suggesting that it has an alternative catalytic function (ACF). Furthermore, it is impossible to classify KinII as either a protein-serine/threonine or a protein-tyrosine kinase, as the indicative regions in subdomain VI and VII are not conserved. Our sequence analysis of WTK1 did not reveal homology to known membrane-targeting motives, nor to any receptor-like sequences.

Structure of Wtk1 from CS and Zavitan

A search for WTK1 sequences in the chromosome arm 1BS of CS and Zavitan whole genome assemblies revealed the presence of non-functional alleles, designated as wtk1, in both of these susceptible lines. These alleles differ from the functional Wtk1 allele of G25 by large insertions in intron 1 and 3 for both CS and Zavitan, stop codon in exon 4 in Zavitan and indel in exon 4 for CS. A search in two databases of transposable elements (TE)-mipsREdat_9.3p Poaceae_TEs and trep-db_complete_Rel-16—identified the presence of three TEs: (i) RLX_Taes_Veju (intron 1 of CS and Zavitan); (ii) DTH_158357|trep3042|DNA/Harbinger (intron 3 of CS and Zavitan); (iii) DTM_Hvul_Spring-_TREP1674-1 *Hordeum vulgare*; DNA-transposon, TIR, Mutator—MITE (intron 3 of CS). These results are presented in FIG. 3.

Example 1: Isolation of the Yr15 Nucleotide Sequence

Previously, Yr15 was mapped on the short arm of chromosome 1B. A recombinant inbred family segregating for Yr15 was generated by crossing resistant introgression *durum* lines (B9, B10), which carry Yr15 from DIC G25, with the susceptible recurrent line D447. 8573 $F_2$ plants and 12 DNA markers derived from the collinear region in Brachypodium, *Oryza*, and *Sorghum* (Tables 1, 2, and 3) were used to map Yr15 0.17 cM distal to uhw259 and 0.13 cM proximal to uhw264 (FIG. 1, Table 4). The target interval was then saturated with 24 markers developed based on bacterial artificial chromosome (BAC) sequences positioned on the physical map of 1BS chromosome arm of *T. aestivum*, cv. Chinese Spring (CS) (Table 5), from the genomic sequence of DIC accession Zavitan (Zavitan) (Table 6, FIG. 2), or from a G25 BAC sequence. Using these markers, we mapped Yr15 between markers uhw300 and uhw273 (0.013 cM) (FIG. 3).

TABLE 1

Description of PCR markers in the Yr15 region developed from wheat ESTs assigned to deletion bin Sat0.31.

| Marker name[a] | EST | Primer sequence (SEQ ID NO) | Fragment size (bp) | Annealing temp (° C.) | Restriction enzyme | Parental alleles (bp) |
|---|---|---|---|---|---|---|
| uhw250 | BG275046 | CTGCTCACTT TTTGCCTGTG AAAAGTTGT TGCTCTGCTT TT (19) | 1355 | 50 | — | B9: 1355 D447: Null |
| uhw252 | BG607503 | GGTTTTCACT GAATCAATA GGGATGAAC CCAGCCAGT CTGAT (20) | 550 | 57 | SspI | B9: 552 D447: 328, 222 |
| uhw254 | BG608205 | CAATCCCAA GCTGACTGA AAACACCGC TGGTATTGTA GCC (21) | 737 | 60 | AluI | B9: 479, 258 D447: 737 |

[a]Marker order from distal to proximal relative to Yr15, is described in FIG. 2.

TABLE 2

Description of KASP markers in the Yr15 region developed based on SNP markers from wheat 15K SNP array.

| Marker name | Primer sequence A (SEQ ID NO) | Primer sequence B (SEQ ID NO) | Primer sequence Common (SEQ ID NO) |
|---|---|---|---|
| RAC875_c826_839 | ACGAAGGTTCTGTTTTCACCA (22) | ACGAAGGTTCTGTTTTCACCG (23) | TCTTCTTGCTCAAAGGTAAGAGT (24) |
| BS00022902_51 | ATGTGCGGCAGGAGAAGA (25) | ATGTGCGGCAGGAGAAGG (26) | ATACTCTTCACGGTCGTCTTC (27) |

PCR conditions using the StepOne Plus Real-Time PCR system (Applied Biosystems, Carlsbad, CA, USA): TD-61° C., 60 sec (15 cycles)/55° C., 60 sec (32 cycles)

TABLE 3

Description of markers in the Yr15 region developed using collinearity to *B. distachyon*, *O. sativa*, and *S. bicolor*.

| Marker Name | EST/Unigene | Primer Sequence (SEQ ID NO) | Frag Size (bp) | Anneal Temp (° C.) | Res. Enzyme | Parental alleles (bp) | B. dis homolog | O. sat homolog | S. bic homolog |
|---|---|---|---|---|---|---|---|---|---|
| uhw256 | HU35_455 | GTTACCCTCCACAGCAAGGTGCGCATTACTTCCACTTCTTG (28) | 949 | 59 | AluI | B9: 347, 310, 203, 60, 29 D447: 657, 203, 60, 29 | Bradi2g37690.1 | LOC_Os05g02780.1 | Sb09g001970 |
| uhw255 | CJ661523 | GATGCTCTGCACATGTGTTATGGCAGCTCCAGCTTATTCGTC (29) | 753 | 55 | MseI | B9: 243, 184, 150, 149, 71, 25 D447: 333, 243, 81, 71, 25 | Bradi2g37870.1 | LOC_Os05g03100.1 | Sb09g002120 |
| uhw264 | CA730189 | GGTCTCTTGCAACATACAGTAACAAGAGTGGTAGTCTAGTAGAGGTTGGTG (30) | 247, 215 | 58 | | B9: 215 D447: 247 | Bradi2g37920.1 | LOC_Os05g03120.1 | Sb09g002140 |
| uhw259 | CD927978 | CTGTATTCTAATGCAGATTAGCTGTTCACGCATAATTTTGTCCACAC (31) | 302 | 57 | BsrI | B9: 112, 100, 90 D447: 190, 112 | Bradi2g37950.1 | LOC_Os05g03140.1 | Sb09g002180 |
| uhw260 | CK155408 | GAGACGAACGAAACCGAGATGATAGTGTCAATTGGTGGAAGG (32) | 381 | 58 | EcoRV | B9: 300, 81 D447: 381 | Bradi2g37970.1 | LOC_Os05g03174.1 | Sb09g002200 |
| uhw262 | BQ161309 | TTTGCTTTGGAGTCCCAGTTTTTGCAAAAGTAATCCTGGACA | 915 | 59 | NlaIV | B9: 915 bp DW1: 674, 241 bp | Bradi2g38030.1 | LOC_Os05g03430.1 | Sb09g002225 |

TABLE 3-continued

Description of markers in the Yr15 region developed using collinearity to
B. distachyon, O. sativa, and S. bicolor.

| Marker Name | EST/ Uni-gene | Primer Sequence (SEQ ID NO) | Frag Size (bp) | Anneal Temp (° C.) | Res. Enzyme | Parental alleles (bp) | B. dis homolog | O. sat homolog | S. bic homolog |
|---|---|---|---|---|---|---|---|---|---|
| uhw263 | CJ84 1447 | CACCAG TAGATC CTCAAC AATACA CTTGAG AATGGA ATGCAA CGTAG (33) | 539 | 58 | Dra III | B9: 539 D447: 344, 195 | Bradi2g38030. 1 | LOC_ Os05g03430. 1 | Sb09g002225 |
| uhw257 | CJ58 2219 | TCTTAC TTGTTC ACAAAA CTGAGG GCGCAT GAGGAG CTTGAC (34) | 834 | 57 | | B9: Null D447: 834 | Bradi2g38170. 1 | LOC_ Os05g03610. 1 | Sb09g002320 |

TABLE 4

Graphical genotyping and phenotyping of selected 13 RILs with the closest recombination events flanking Yr15.

| Markers/ Parents and RILs | uhw264 | uhw297 | uhw292 | uhw300 | uhw301 | Yr15 | uhw296 | uhw302 | uhw276 | uhw273 | uhw275 | uhw291 | uhw274 | uhw259 |
|---|---|---|---|---|---|---|---|---|---|---|---|---|---|---|
| B9 | B | B | B | B | B | R | B | B | B | B | B | B | B | B |
| B10-50-5-4 | B | D | D | D | D | S | D | D | D | D | D | D | D | D |
| B10-52-54-8 | D | B | B | B | B | R | B | B | B | B | B | B | B | B |
| B9-110-24-3 | B | B | D | D | D | S | D | D | D | D | D | D | D | D |
| B9-14-14-7 | D | D | B | B | B | R | B | B | B | B | B | B | B | B |
| B9-205-19-3 | D | D | D | B | B | R | B | B | B | B | B | B | B | B |
| B9-L24-53-4 | B | B | B | B | D | S | D | D | D | D | D | D | D | D |
| B9-167-105-1 | D | D | D | D | D | S | D | D | D | B | B | B | B | B |
| B9-208-9-16 | D | D | D | D | D | S | D | D | D | D | B | B | B | B |
| B9-183-45-1 | B | B | B | B | B | R | B | B | B | B | B | D | D | D |
| B9-14-23-15 | D | D | D | D | D | S | D | D | D | D | D | B | B | B |
| B9-L70-33-13 | B | B | B | B | B | R | B | B | B | B | B | B | D | D |
| B9-167-63-1 | B | B | B | B | B | R | B | B | B | B | B | B | B | D |
| B9-112-22-2 | D | D | D | D | D | S | D | D | D | D | D | D | D | B |
| D447 | D | D | D | D | D | S | D | D | D | D | D | D | D | D |

Marker alleles identical to those obtained for the PST resistant parental line B9 ('B'); marker alleles identical to those obtained for the Pst susceptible parental line D447 ('D'). Resistance (R) or susceptibility (S) to Pst is specified.

TABLE 5

Molecular markers developed from chromosome arm 1BS physical map of CS, and from G25 BAC clone G25-64.

| Marker Name | Marker Type | Sequence based design | Primer Sequences (SEQ ID NO:) | Length | Conditions | Enzyme | Parental alleles (bp) | *CS 1BS BAC clone |
|---|---|---|---|---|---|---|---|---|
| uhw267 | Genetic, co-dominant, CAPS | BES Sanger, BlastN EST CJ883493 | TGGTAAT CAAGTTT CACATTG TTCA (35) GGAAGG ACACCT TTCGGT ATT (36) | 696 | 65/55; 0'40 | NheI | B9: 696 D447: 542, 172 | TaaCsp1B S057E21 |

TABLE 5-continued

Molecular markers developed from chromosome arm 1BS physical map of CS, and from G25 BAC clone G25-64.

| Marker Name | Marker Type | Sequence based design | Primer Sequences (SEQ ID NO:) | Length | Conditions | Enzyme | Parental alleles (bp) | *CS 1BS BAC clone |
|---|---|---|---|---|---|---|---|---|
| uhw297 | Genetic, co-dominant, CAPS | PacBio, Uniprot | CAGATGACCAACCAAAAGCA (37) GTCATATTGGTGCCCAGTGA (38) | 487 | 65/55; 0'40 | BauI | B9: 487 D447: 450, 37 | TaaCsp1B S118O15 |
| uhw292 | Genetic, B9 dominant | BES IWGSC BLAST, BlasttX, Protein EMT24064 | GACTTTCTTCCCTCGGGACT (39) CTCGCACGCCTATAAAAGGA (40) | 1000 | 65/55; 1'00 | — | B9: 1000 D447: null | TaaCsp1B S139J04 |
| uhw296 | Genetic, co-dominant, CAPS | PacBio, BlastX, Proteins EMS53293 and EMT11639 | CAACCGTGCCTCCAAACA (41) CGGGTGTTGTCCGTTGAG (42) | 497 | 65/55; 0'50 | NlaIV | B9: 321, 176 D447: 299, 176, 22 | TaaCsp1B S050H19 |
| uhw276 | Genetic, co-dominant, CAPS | BES, 454, BlastX, Protein EMT12025 | TCTGTGATGCCTGTGATGGT (43) AAAGTTTGGGATTTGGCAAT (44) | 755 | 55; 0'40 | TaqI | B9: 309, 163, 73, 72, 71, 47, 20 D447: 182, 163, 127, 74, 73, 69, 47 | TaaCsp1B S112E24 |
| uhw273 | Genetic, co-dominant, CAPS | BES, BlastX Protein EMT27971, RGA | GGTGACGGCGAGTGTACG (45) GACGCAATTGTCCGCTGT (46) | 242 | 62/52, 0'25 | EagI | B9: 149, 93 D447: 242 | TaaCsp1B S112E24 |
| uhw275 | Genetic, co-dominant, CAPS | 454, BlastX, Protein EMS52762 | CAATGCTCGTAGCTGTTCCA (47) GAGCATTGTTGGGGGTTG (48) | 549 | 65/55; 0'30 | TaiI | B9: 344, 205 D447: 344, 147, 58 | TaaCsp1B S119N09 |
| uhw291 | Genetic, co-dominant, CAPS | 454, ISBP Finder TE junction | TGTTGCTATGCCATCACCAT (49) CTATACCGCTGGTGGGAGAA (50) | 285 | 65/55; 0'30 | MspI | B9: 142, 94, 49 D447: 143, 142 | TaaCsp1B S131B08 |

TABLE 5-continued

Molecular markers developed from chromosome arm 1BS physical map of CS, and from G25 BAC clone G25-64.

| Marker Name | Marker Type | Sequence based design | Primer Sequences (SEQ ID NO:) | Length | Conditions | Enzyme | Parental alleles (bp) | *CS 1BS BAC clone |
|---|---|---|---|---|---|---|---|---|
| uhw274 | Genetic, co-dominant, CAPS | 454, BlastX, Protein EMS64309 | AAGCTC CGCTGC AATGAC (51) ACCTGA CATCCT CGAACC AC (52) | 314 | 65/55; 0'30 | HaeIII | B9: 196, 118 D447: 314 | TaaCsp1B S037C16 |
| uhw282 | Genetic, co-dominant, CAPS | 454, BlastX, Protein EMT33303 | TAATGT TTGGAC GAGGCA CA (53) TTTTTAC TTGTTGC TTGTTAC AATTT (54) | 815 | 65/55; 0'40 | AciI | B9: 223, 214, 142, 130, 93, 10 D447: 359, 223, 130, 93, 10 | TaaCsp1B S017L14 |

TABLE 6

Molecular markers developed from sequences of G25 BAC clone G25-141 and the Zavitan 1BS pseudomolecule.

| Marker Name | Marker Type | Primer sequence (SEQ ID NO:) | Length |
|---|---|---|---|
| uhw300 | Genetic, B9 dominant | CCGTGTCAGCCACCTACAAT (55) GCACTCTACCACCGAACACA (56) | 863 bp |
| uhw301 | Genetic, B9 dominant | GTAGTGGCTCGTTCGGTGAT (57) TTTCGCATCCCACCCTACTG (58) | 936 bp |
| uhw302 | Genetic, B9 dominant | CATCCATTCCTCCGACAAGT (59) CACTGCAATGCAAAAATGCT (60) | 216 bp |

A pooled BAC library, constructed for Yr15 donor G25, was screened with closely linked markers Xuhw292, Xuhw297, Xuhw296, and Xuhw273. The sequencing of the six BACs identified with these markers yielded two non-overlapping contigs (G25ctg1—286,738 bp and G25ctg2—131,485 bp) (FIG. 3). Sequence analysis of these contigs revealed the presence of three putative candidate genes. One of them contained predicted protein domains that have been previously associated with plant responses to pathogens and therefore was selected first for validation. This gene has two distinct kinase-like domains arranged in tandem and is designated here as WHEAT TANDEM KINASE 1 (Wtk1) (FIG. 3). Alignment of the Wtk1 full-length complementary DNA (cDNA, 1998 bp, SEQ ID NO: 1) against the Wtk1 genomic DNA sequence (4,657 bp, SEQ ID NO: 3) indicated that the gene contains six exons coding for a 665 amino acid protein (SEQ ID NO: 2). Based on this gene we developed DNA marker uhw301 that co-segregated with the Yr15 phenotype.

Example 2: Wtk1 Functionality

To validate the function of Wtk1, ethylmethane sulfonate (EMS) was used to mutagenize a set of Yr15 ILs and identified two out of 2,112 tetraploid and eight out of 1,002 hexaploid $M_2$ families, that segregated for resistance to Pst (FIG. 4A-4B, Table 7). Sequencing of Wtk1 in the susceptible $M_2$ plants confirmed the presence of independent missense mutations in each mutant. There were five EMS mutants contained amino acid changes in the Wtk1 kinase-like domain I (KinI) and five in kinase-like domain II (KinIII) (FIG. 4A, Table 7). In $F_2$ progenies derived from the crosses between the susceptible EMS4 and EMS6 mutants and the resistant wild type Avocet+Yr15, homozygosity for wtk1 mutations co-segregated with susceptibility to Pst (Table 8). The ten independent mutants demonstrate that both KinI and KinII domains of WTK1 are necessary for the resistance conferred by Yr15.

TABLE 7

Molecular characterization of the Wtk1 EMS mutants.

| Mut. line No. | Protein domain in WTK1 | Line ID | Nucleotide change[1] | Effect on amino acid[2] | Reaction to Pst[3] | SIFT[4] | Ploidy |
|---|---|---|---|---|---|---|---|
| EMS1 | KinI | Suncea + yr15-L18 | G 160 A | G 54 S | Susceptible | 0.00 | 6X |
| EMS2 | KinI | Suncea + yr15-L89 | G 340 A | E 114 K | Susceptible | 0.02 | 6X |
| EMS3 | KinI | B9 + yr15-L1351 | G 448 A | E 150 K | Susceptible | 0.87 | 4X |
| EMS4 | KinI | Avocet + yr15-1 | C 482 T | P 161 L | Susceptible | 0.00 | 6X |
| EMS5 | KinI | Avocet + yr15-L90 | C 632 T | P 211 L | Susceptible | 0.00 | 6X |
| EMS6 | KinII | Avocet + yr15-13 | G 2922 A | A 460 T | Susceptible | 0.00 | 6X |
| EMS7 | KinII | Excalibur + yr15-6L306 | G 3114 A | D 524 N | Susceptible | 0.33 | 6X |
| EMS8 | KinII | Avocet + yr15-L72 | C 3229 T | T 562 I | Susceptible | 0.00 | 6X |
| EMS9 | KinII | B9 + yr15-LF | C 3315 T | P 591 S | Susceptible | 0.85 | 4X |
| EMS10 | KinII | Excalibur + yr15-L137 | G 3469 A | V 614 M | Susceptible | 0.14 | 6X |

[1]The first letter indicates the wild-type nucleotide, the number indicates its position relative to the ATG start codon, and the last letter shows the mutant nucleotide.
[2]The first letter indicates the wild-type amino acid, the number indicates its position relative to the start methionine, and the last letter shows the mutated amino acid.
[3]Rust severity was evaluated and characterized 14-18 days after inoculation with Pst isolate #5006 using a 0-9 scale of infection type (IT): 0-3 is considered resistant (R), 4-6 moderately resistant, and 7-9 susceptible (S). The complete WTK1 coding regions of the above ten mutagenized lines were sequenced and no additional mutations were detected.
[4]The WTK1 mutations were ranked using the SIFT. Low SIFT scores (<0.05) predict mutations with severe effects on protein function.

TABLE 8

Segregation ratio of resistance and susceptible phenotypes in $F_2$ families of EMS mutagenized lines carrying yr15 susceptible allele crossed with wild type Avocet + Yr15 following inoculation with Pst isolate #5006.

| Cross | $F_2$ Resistant | $F_2$ Susceptible | Postulated ratio | $\chi^2$ value | P-value* |
|---|---|---|---|---|---|
| EMS4/Avocet + Yr15 | 82 | 24 | 3:1 | 0.31 | 0.29 |
| EMS6/Avocet + Yr15 | 77 | 28 | 3:1 | 0.16 | 0.35 |

*P-value for one-tail test of significance for $\chi^2$ statistics with df = 1

To determine if Wtk1 was sufficient to confer Pst resistance, the susceptible varieties T. aestivum cv. Fielder and T. durum cv. Kronos were transformed with a 9.1 kb genomic fragment that includes the complete Wtk1 coding and flanking regions. Expression of the Wtk1 transgene was detected in 17 out of 22 $T_0$ transgenic plants and their progenies. In subsequent generations, the Wtk1 transgene co-segregated with the stripe rust resistance phenotype (FIG. 4C-4J), thereby demonstrating that Wtk1 is Yr15.

Example 3: Splice Variants of Wtk1 and Kinase Domain Characterization

Three alternative transcript variants (Main isoform, Isoform2 and Isoform3, FIG. 5) were revealed by sequencing of 48 Wtk1 cDNAs. Whereas Main isoform encodes the complete Wtk1 protein, the other two (Isoform2 and 3) encode truncated forms. Wtk1 is expressed in roots, stems, and leaves (FIG. 6A). Transcript levels of the three Wtk1 isoforms varied with time and were significantly lower at all days post inoculation (dpi) in leaves of B9 inoculated with Pst, relative to mock-inoculated plants (FIG. 6B-6D). In addition, a significant reduction in expression of Wtk1 isoforms was observed over time (1-9 dpi) for both Pst- and Mock-inoculated plants (FIG. 6B-6D). These findings suggest that expression of Wtk1 is down-regulated by the presence of the pathogen, and show a slight reduction during aging of the leaves.

Both WTK1 kinase-like domains belong to the Protein Kinase catalytic domain-like superfamily and display neither membrane-targeting motifs nor known receptor sequences (FIG. 7). A fusion of the WTK1 protein with green fluorescent protein (GFP) showed a cytoplasmic localization (with some partition into the nucleus) in barley protoplasts (FIG. 8A-8I). Hence, the localization pattern of WTtk1 is consistent with the lack of a recognizable transmembrane domain such as found in wall-associated kinases. A comparison of Wtk1 with the kinase-like domains of 23 plant pattern recognition receptors (PRR) suggests that KinI probably belongs to the serine/threonine non-RD kinase-like group, while KinII probably belongs to an alternative catalytic function (ACF) kinase-like group (FIG. 7). Only two of these proteins have a tandem kinase structure similar to Wtk1: barley RPG1, conferring resistance to stem rust; and MLOC_38442.1, which is proposed as a candidate for the barley true loose smut resistance gene Un8. However, these proteins are relatively dissimilar to Wtk1 (RPG1 27% similarity; MLOC_38442.1 37%). Moreover, when comparing each kinase domain separately, Wtk1 KinI shows a higher similarity to MLOC_38442.1 KinI (56%) than to RPG1 KinI (27%), while Wtk1 KinII shows comparable levels of similarity to both RPG1 and MLOC_38442.1 KinII (29% and 24%, respectively). Since the kinase-like domains in both barley proteins are distant from Wtk1 (FIG. 9), it seems that Wtk1 may represents a different tandem combination of two distinct kinase-like domains not reported before in other disease resistance genes.

Example 4: Wtk1 Homologs and Non-Functional Counterparts

A search for Wtk1 sequences in the chromosome arm 1BS of CS and Zavitan whole genome assemblies revealed the presence of non-functional alleles, designated as wtk1, in both of these susceptible lines. These alleles differ from the functional Wtk1 allele of G25 by indels (e.g. insertions of transposable elements such as Veju, Harbinger and MITE) that have changed the reading frame of exon 4 and generated premature stop codons in CS and Zavitan, relative to G25 (FIG. 3).

Collinear orthologs of Wtk1 were found on all homologous group 1 chromosomes of tetraploid (*Triticum turgidum* ssp. *dicoccoides*, genome composition AABB) and hexaploid wheat (*T. aestivum*, AABBDD), as well as in diploid wheat relatives *Triticum urartu* (AA), *Aegilops speltoides* (SS), *Aegilops tauschii* (DD), representing the A, B, and D genomes, respectively, and in the 1R chromosome of rye (*Secale cereale*, RR). A phylogenetic analysis, conducted at the protein level, clustered all of these onto one branch, consisting of subclusters corresponding to the 1A, 1B and 1D copies (FIG. 10). No Wtk1 ortholog was detected on chromosome 1H of barley (*Hordeum vulgare*, HH). Paralogs of Wtk1 were found on the homeologous group 6 chromosomes of tetraploid and hexaploid wheat, their diploid relatives *T. urartu* and *Ae. tauschii*, and on chromosome 6H of barley. All group 6 copies were clustered together. An orthologous copy from chromosome Bd2 of Brachypodium distachyon had an intermediate position between the two clusters, while the closest protein from rice (*Oryza sativa*) was placed as an outgroup. The presence of Wtk1 paralogs on both group 1 and group 6 chromosomes of almost all diploid wheat species, as well as the relatively low nucleotide sequence identity between group 1 and group 6 paralogs of Wtk1 (~80% in KinI and ~30% in KinII), suggests an old duplication event.

380 *Triticum* accessions were evaluated for the presence of Wtk1 alleles. The functional Wtk1 allele was detected in 18% of the accessions of the Southern (Israel, Lebanon, Jordan, or Syria) DIC populations and not detected in the Northern (Turkey or Iran) populations (Tables 9 and 10) from which domesticated wheat is thought to have been derived. This suggests that Wtk1 was not incorporated into the initial domesticated forms. Diagnostic Kompetitive Allele Specific PCR (KASP) markers for each kinase-like domain of WTK1 (SEQ ID NOs: 107-109 for KinI and SEQ ID Nos: 110-112 for KinIII) were developed, and they can differentiate between functional (Wtk1) and non-functional (wtk1) alleles (Table 11, FIG. 11A-11B, lines listed in 11C). Screening of 85 *durum* and common wheat accessions with these markers showed that the functional Wtk1 allele was present only in the recently developed Yr15 ILs (Table 12). This result suggests that Yr15 has the potential to improve stripe rust resistance in a wide range of tetraploid and hexaploid wheat germplasm. The absence of the functional Wtk1 in the tested *durum* and common wheat varieties also highlights the value of the DIC germplasm as a reservoir of resistance genes for wheat.

TABLE 9

DIC accessions evaluated for presence of Wtk1 or wtk1 alleles. Each accession was evaluated with two sets of diagnostic markers designed respectively to amplify the two kinase-like domains of the gene (See Table 11).

| Wheat | No. | Wtk1 | Accession number[1] |
|---|---|---|---|
| DIC Southern population[2] | 29 | Wtk1 | TD103986, TD104084, TD104266, TD104326, TD104422, TD104424, TD104430, TD104432, TD104447, TD104668, TD104732, TD104733, TD104785, PI233288, PI428100, PI428126, PI428127, PI428132, PI428135, PI428143, PI466991, PI503314, PI538690, PI538700, PI503316, IG46526, IG46504, CGN19932, CGN21078 |
| | 133 | wtk1 | TD103984, TD103989, TD104006, TD104015, TD104019, TD104020, TD104541, TD104542, TD104064, TD104068, TD104069, TD104073, TD104088, TD104089, TD104093, TD104134, TD104136, TD104139, TD104140, TD104144, TD104552, TD104555, TD104157, TD104159, TD104168, TD104172, TD104173, TD104177, TD104183, TD104191, TD104205, TD104213, TD104214, TD104559, TD104247, TD104249, TD104253, TD104255, TD104257, TD104261, TD104263, TD104268, TD104279, TD104290, TD104293, TD104294, TD104302, TD104306, TD104336, TD104375, TD104397, TD104404, TD104409, TD104413, TD104425, TD104429, TD104434, TD104446, TD104449, TD104453, TD104455, TD104463, TD104465, TD104466, TD104467, TD104469, TD104470, TD104531, TD104597, TD104599, TD104600, TD104619, TD104621, TD104628, TD104684, TD104727, TD104742, TD104751, TD104755, TD104757, TD104764, TD104766, TD104767, TD104768, TD104774, PI414719, PI414720, PI414721, PI414722, PI428014, PI428093, PI428097, PI428099, PI428105, PI428119, PI466949, PI466955, PI466981, PI467004, PI471016, PI471035, PI487253, PI487255, PI503312, PI503315, PI538680, PI538684, PI538685, PI538699, PI538719, IG46439, IG46457, IG46473, IG46466, |

TABLE 9-continued

DIC accessions evaluated for presence of Wtk1 or wtk1 alleles. Each accession was evaluated with two sets of diagnostic markers designed respectively to amplify the two kinase-like domains of the gene (See Table 11).

| Wheat | No. | Wtk1 | Accession number[1] |
|---|---|---|---|
| DIC Northern population[3] | 19 | wtk1 | IG46492, IG46476, IG45490, IG45493, IG45494, IG45500, IG45502, IG45676, IG45726, IG45964, IG46320, IG46323, IG46324, IG46352, IG46386, IG46397, IG46420, IG110737, IG110815 PI428017, PI428018, PI428053, PI428054, PI428069, PI428077, PI428092, PI538626, PI538633, PI538651, PI538656, PI538657, PI554580, PI554582, PI554583, PI503310, PI428016, IG116173, IG116184 |

[1]Accession sources are indicated in the Materials and Methods.
[2]Wild emmer wheat originated from Israel, Lebanon, Jordan, and Syria.
[3]Wild emmer wheat originated from Turkey, and Iran.

TABLE 10

*Triticum* and *Aegilops* species evaluated for the presence of Wtk1. Each accession was screened by PCR for the KinI and KinII regions of Wtk1 with gene-specific diagnostic markers (See Table 11).

| Germplasm number/variety number[1] | genus | species | subspecies | KinI | KinII |
|---|---|---|---|---|---|
| CGN4219 | Triticum | turgidum | dicoccum | − | − |
| CGN6542 | Triticum | turgidum | dicoccum | − | − |
| CGN6543 | Triticum | turgidum | dicoccum | − | − |
| CGN7965 | Triticum | turgidum | dicoccum | − | − |
| CGN7966 | Triticum | turgidum | dicoccum | − | − |
| CGN7975 | Triticum | turgidum | dicoccum | − | − |
| CGN8031 | Triticum | turgidum | dicoccum | − | − |
| CGN8104 | Triticum | turgidum | dicoccum | − | − |
| CGN8344 | Triticum | turgidum | dicoccum | − | − |
| CGN8345 | Triticum | turgidum | dicoccum | − | − |
| CGN8348 | Triticum | turgidum | dicoccum | − | − |
| CGN8350 | Triticum | turgidum | dicoccum | − | − |
| CGN8356 | Triticum | turgidum | dicoccum | − | − |
| CGN8362 | Triticum | turgidum | dicoccum | − | − |
| CGN10424 | Triticum | turgidum | dicoccum | − | − |
| CGN10425 | Triticum | turgidum | dicoccum | − | − |
| CGN11482 | Triticum | turgidum | dicoccum | − | − |
| CGN11486 | Triticum | turgidum | dicoccum | − | − |
| CGN12275 | Triticum | turgidum | dicoccum | − | − |
| CGN12278 | Triticum | turgidum | dicoccum | − | − |
| CGN16105 | Triticum | turgidum | dicoccum | − | − |
| CGN21064 | Triticum | turgidum | dicoccum | − | − |
| CGN21069 | Triticum | turgidum | dicoccum | − | − |
| CGN12283 | Triticum | turgidum | dicoccum | − | − |
| CGN13154 | Triticum | turgidum | dicoccum | − | − |
| PI532302 | Triticum | turgidum | dicoccum | − | − |
| PI319868 | Triticum | turgidum | dicoccum | − | − |
| PI319869 | Triticum | turgidum | dicoccum | − | − |
| PI355454 | Triticum | turgidum | dicoccum | − | − |
| PI355496 | Triticum | turgidum | dicoccum | − | − |
| PI352357 | Triticum | turgidum | dicoccum | − | − |
| PI352348 | Triticum | turgidum | dicoccum | − | − |
| PI352367 | Triticum | turgidum | dicoccum | − | − |
| PI352352 | Triticum | turgidum | dicoccum | − | − |
| PI182743 | Triticum | turgidum | dicoccum | − | − |
| PI352361 | Triticum | turgidum | dicoccum | − | − |
| PI191091 | Triticum | turgidum | dicoccum | − | − |
| PI276007 | Triticum | turgidum | dicoccum | − | − |
| PI606325 | Triticum | turgidum | dicoccum | − | − |
| PI352329 | Triticum | turgidum | dicoccum | − | − |
| PI94741 | Triticum | turgidum | dicoccum | − | − |
| PI377658 | Triticum | turgidum | dicoccum | − | − |
| PI264964 | Triticum | turgidum | dicoccum | − | − |
| PI470739 | Triticum | turgidum | dicoccum | − | − |
| PI94661 | Triticum | turgidum | dicoccum | − | − |
| PI470737 | Triticum | turgidum | dicoccum | − | − |
| PI326312 | Triticum | turgidum | dicoccum | − | − |
| PI94640 | Triticum | turgidum | dicoccum | − | − |
| CGN4222 | Triticum | turgidum | carthlicum | − | − |
| CGN6596 | Triticum | turgidum | carthlicum | − | − |
| CGN8389 | Triticum | turgidum | polonicum | − | − |
| CGN8391 | Triticum | turgidum | polonicum | − | − |
| CGN12289 | Triticum | turgidum | polonicum | − | − |
| CGN12291 | Triticum | turgidum | polonicum | − | − |
| CGN12293 | Triticum | turgidum | polonicum | − | − |
| CGN4224 | Triticum | monococcum | | − | − |
| CGN6598 | Triticum | monococcum | | + | − |
| CGN6602 | Triticum | monococcum | | + | − |
| CGN9956 | Triticum | monococcum | | − | − |
| CGN10500 | Triticum | monococcum | | − | − |
| CGN10682 | Triticum | speltoides | | − | − |
| CGN10684 | Triticum | speltoides | | − | − |
| CGN10686 | Triticum | speltoides | | − | − |
| CGN10687 | Triticum | speltoides | | − | − |
| CGN10692 | Triticum | speltoides | | + | − |
| CGN10697 | Triticum | speltoides | | − | − |
| CGN10698 | Triticum | speltoides | | − | − |
| CGN10671 | Triticum | speltoides | speltoides | − | − |
| CGN10673 | Triticum | bicorne | | − | − |
| CGN10672 | Triticum | bicorne | | − | − |
| CGN6525 | Triticum | triunciale | | + | − |
| CGN6604 | Triticum | triunciale | | + | − |
| CGN10660 | Triticum | triunciale | | + | − |
| CGN8408 | Triticum | timopheevii | timopheevii | − | − |
| CGN10495 | Triticum | timopheevii | timopheevii | − | − |
| CGN10497 | Triticum | timopheevii | timopheevii | − | − |
| CGN10677 | Triticum | longissimum | longissima | − | − |
| CGN10681 | Triticum | longissimum | longissima | − | − |
| CGN10777 | Triticum | longissimum | sharonensis | − | − |
| CGN16088 | Triticum | longissimum | sharonensis | − | − |
| CGN13124 | Triticum | longissimum | sharonensis | − | − |
| CGN13111 | Triticum | longissimum | | − | − |
| CGN16014 | Triticum | longissimum | | − | − |
| CGN13113 | Triticum | squarrosum | | − | − |
| CGN10734 | Triticum | squarrosum | | − | − |
| CGN16008 | Triticum | squarrosum | | − | − |
| CGN13119 | Triticum | squarrosum | | − | − |
| CGN13116 | Triticum | cylindricum | | − | − |
| CGN13117 | Triticum | cylindricum | | − | − |
| CGN10704 | Triticum | crassum | | + | − |
| CGN10706 | Triticum | crassum | | + | − |
| CGN10707 | Triticum | ventricosum | | − | − |
| CGN10712 | Triticum | ventricosum | | − | − |
| CGN6613 | Triticum | ovatum | | + | − |
| CGN10668 | Triticum | ovatum | | + | − |
| CGN10664 | Triticum | triaristatum | | + | − |

TABLE 10-continued

*Triticum* and *Aegilops* species evaluated for the presence of Wtk1. Each accession was screened by PCR for the KinI and KinII regions of Wtk1 with gene-specific diagnostic markers (See Table 11).

| Germplasm number/variety number[1] | genus | species | subspecies | KinI | KinII |
|---|---|---|---|---|---|
| CGN21070 | *Triticum* | *triaristatum* | | + | − |
| CGN10774 | *Triticum* | *triunciale* | | − | − |
| CGN6606 | *Triticum* | *kotschyi* | | + | − |
| CGN6607 | *Triticum* | *columnare* | | + | − |
| CGN6077 | *Triticum* | *ventricosum* | | − | − |
| CGN16015 | *Triticum* | *lorentii* | | + | − |
| CGN16016 | *Triticum* | *caudatum* | | − | − |
| CGN16017 | *Triticum* | *peregrinum* | | + | − |
| PI542175 | *Aegilops* | *comosa* | | − | − |
| PI551036 | *Aegilops* | *comosa* | | − | − |
| PI551038 | *Aegilops* | *comosa* | | − | − |
| PI551034 | *Aegilops* | *comosa* | | − | − |
| PI551032 | *Aegilops* | *comosa* | | − | − |
| PI551020 | *Aegilops* | *comosa* | | − | − |
| PI551080 | *Aegilops* | *comosa* | | − | − |
| PI551031 | *Aegilops* | *comosa* | | − | − |
| PI276970 | *Aegilops* | *comosa* | | − | − |
| PI551047 | *Aegilops* | *comosa* | | − | − |

[1]Accession sources are indicated in the Materials and Methods.

TABLE 11

PCR primers used for the functional characterization of Wtk1.

| Function | | Primer name | Primer sequence (SEQ ID NO:) |
|---|---|---|---|
| Transgenics | | Yr15F1 | CACCCTCGAGCGAGGTGGTCGTCCAGTAGTT (61) |
| | | Yr15R1 | CTAAGGAGACTACAGACCTAACAT (62) |
| | | Yr15F2 | CACCCAGTAGGGTGGGATGCGAAATA (63) |
| | | Yr15R2 | CTTTACCTAGGTTCTCTCTCCATCCCAACCAAT (64) |
| | | HpyF1 | GGCCTCCAGAAGAAGATGTTGG (65) |
| | | HpyR1 | GAGCCTGACCTATTGCATCTCC (66) |
| | | Yr15TestF1 | TGGGTCGAAGGAAACAAATA (67) |
| | | Yr15TestR1 | AACAGCACTGCGATGGTAATA (68) |
| | | Y15K1_F2 | GGAGATAGAGCACATTACAGAC (69) |
| | | Xuhw301R | TTTCGCATCCCACCCTACTG (70) |
| Transcription | qRT-PCR | Ubiquitin_F | TTGACAACGTGAAGGCGAAG (71) |
| | | Ubiquitin_R | GGCAAAGATGAGAGCTGCT (72) |
| | qRT-PCR | Main_F | GAAATTGATTTGAAGATTGAAGCA (73) |
| | | Main_R | CATATTTGTTTCCTTCGACCCAA (74) |
| | qRT-PCR | Isoform2_F | GTGGCAATGCAGATGGTCCT (75) |
| | | Isoform2_R | TTGAGAAGACTTGATGGCGATGTC (76) |
| | qRT-PCR | Isoform3_F | TCCGACAATGGTTGAGGTAGC (77) |
| | | Isoform3_R | GCAACAATTGCCTTTCCTGTTC (78) |
| | Full-length cDNA | WTK1_L2F | CTGCTGCTACCTGTTCTGTAA (79) |
| | | WTK1_RE6 | ACAGACAGTGACACGGACAT (80) |
| | | E1820 | AAGCAGTGGTAACAACGCAGAGTACTTTTTTTTTTTTTTTTTTTTTTTTT (81) |
| | | E2146 | AAGCAGTGGTAACAACGCAGAGTAC (82) |
| | | Y15F0 | CAGGCAGGCTGCTGCTAC (83) |
| | | Y15F2 | GTCTTCATATGCTGCTTGCAC (84) |
| | | RNAoligo | GCUGAUGGCGAUGAAUGAACACUG (85) |
| | | 5'RACE | GCTGATGGCGATGAATGAACACTG (86) |
| | | Y15R2 | TGCTTCCGCTGACTCGATGC (87) |
| | | Y15R1 | TGCAGCAGCCTAACAATCTG (88) |
| Subcellular localization | | attB4F35S | GGGGACAACTTTGTATAGAAAAGTTGAGATTAGCCTTTTCAATTTCAG (89) |
| | | attB1R35S | GGGGACTGCTTTTTTGTACAAACTTGCGTGTTCTCTCCAAATGAAATG (90) |
| | | attB1FKinase | GGGGACAAGTTTGTACAAAAAAGCAGGCTCCRCCATGGATTACCAAGG (91) |
| | | attB2Rkinase | GGGGACCACTTTGTACAAGAAAGCTGGGTGGTTGATGCCTGTAGAGC (92) |
| | | attB2FGFPnos | GGGGACAGCTTTCTTGTACAAAGTGGGCATGGTGAGCAAGGGCGAGGAGC (93) |
| | | attB3RGFPnos | GGGGACAACTTTGTATAATAAAGTTGCATCTAGAGGGCCCGGATCTG (94) |
| | | attB1Freg | GGGGACAAGTTTGTACAAAAAAGCAGGCTCCRCCATGAAGAAACTAACAAG (95) |
| | | attB2Ryr15 | GGGGACCACTTTGTACAAGAAAGCTGGGTGCTTTTGCAACAATTGCCTC (96) |

TABLE 11-continued

PCR primers used for the functional characterization of Wtk1.

| | Function | Primer name | Primer sequence (SEQ ID NO:) |
|---|---|---|---|
| EMS mutagenized lines screening | | WJKDF1 | GCTGCTGCTACCTGTTCTGT (97) |
| | | WJKDR1 | CCCTACCTAATATCCGCGTGC (98) |
| | | WJKDF2 | TCCCAATCCTTGTGTGCTACC (99) |
| | | WJKDR2 | TTGCCCAGGATTCACCACTA (100) |
| | | WJKDF3 | GCTGCTGGAGCTTTTAACCG (101) |
| | | WJKDR3 | GCGAGAGAACGATTTCCCCT (102) |
| Germplasm screen | KinI | Y15K1_F2 | GGAGATAGAGCACATTACAGAC (69) |
| | | Xuhw301R | TTTCGCATCCCACCCTACTG (70) |
| | KinII | W_2F | TGCACGCGGATATTAGGTAGG (103) |
| | | W_2R | TGATGAAGAGGACCAACGCA (104) |
| | KinI* | Kin1_A | GACCCTTTGTTTTGTCAGAGC (105) |
| | | Kin1_B | GACCCTTTGTTTTGTCAGAGT (106) |
| | | Kin1_C | AAAGATTGAGTAAGACTAGTAGCC (107) |
| | KinII* | Kin2_A | CTGCTACTGGACAGTGTAACG (108) |
| | | Kin2_B | CTGCTACTGGACAGTGCAACA (109) |
| | | Kin2_C | CCCATGTCACGAGGCT (110) |

*KASP Primers PCR conditions: TD-61° C., 60 sec (15 cycles)/55° C., 60 sec (32 cycles) using the StepOne Plus Real-Time PCR system (Applied Biosystems, Carlsbad, CA, USA).

TABLE 12

*Durum* and common wheat accessions evaluated for the presence of Wtk1 and wtk1. Each accession was categorized with gene-specific diagnostic markers for the two kinase-like domains (See Table 11).

| Germplasm number/ variety number | genus | species | sub-species | KinI Wtk1 | KinII Wtk1 | KinI | KinII |
|---|---|---|---|---|---|---|---|
| Aristan[1] | Triticum | turgidum | durum | − | − | wtk1 | wtk1 |
| Villemur[1] | Triticum | turgidum | durum | − | − | wtk1 | wtk1 |
| Muri S 50 3[1] | Triticum | turgidum | durum | − | − | wtk1 | wtk1 |
| Razzak[1] | Triticum | turgidum | durum | − | − | wtk1 | wtk1 |
| Roqueno[1] | Triticum | turgidum | durum | − | − | wtk1 | wtk1 |
| Sabil 1[1] | Triticum | turgidum | durum | − | − | wtk1 | wtk1 |
| Santa[1] | Triticum | turgidum | durum | − | − | wtk1 | wtk1 |
| Siyah Kilakli[1] | Triticum | turgidum | durum | − | − | wtk1 | wtk1 |
| Taganrog[1] | Triticum | turgidum | durum | − | − | wtk1 | wtk1 |
| Vatan[1] | Triticum | turgidum | durum | − | − | wtk1 | wtk1 |
| Waha[1] | Triticum | turgidum | durum | − | − | wtk1 | wtk1 |
| Aziziah[1] | Triticum | turgidum | durum | − | − | wtk1 | wtk1 |
| Baio[1] | Triticum | turgidum | durum | − | − | wtk1 | wtk1 |
| Capeiti8[1] | Triticum | turgidum | durum | − | − | wtk1 | wtk1 |
| Cappelli[1] | Triticum | turgidum | durum | − | − | wtk1 | wtk1 |
| Duilio[1] | Triticum | turgidum | durum | − | − | wtk1 | wtk1 |
| Ofanto[1] | Triticum | turgidum | durum | − | − | wtk1 | wtk1 |
| Simeto[1] | Triticum | turgidum | durum | − | − | wtk1 | wtk1 |
| Triminia[1] | Triticum | turgidum | durum | − | − | wtk1 | wtk1 |
| Tripolino[1] | Triticum | turgidum | durum | − | − | wtk1 | wtk1 |
| Bufala[1] | Triticum | turgidum | durum | − | − | wtk1 | wtk1 |
| Pavone[1] | Triticum | turgidum | durum | − | − | wtk1 | wtk1 |
| Russello[1] | Triticum | turgidum | durum | − | − | wtk1 | wtk1 |
| Timilia[1] | Triticum | turgidum | durum | − | − | wtk1 | wtk1 |
| Nursit 163[2] | Triticum | turgidum | durum | − | − | wtk1 | wtk1 |
| Svevo | Triticum | turgidum | durum | − | − | wtk1 | wtk1 |
| Kronos | Triticum | turgidum | durum | − | − | wtk1 | wtk1 |
| Langdon | Triticum | turgidum | durum | − | − | wtk1 | wtk1 |
| D447[2] | Triticum | turgidum | durum | − | − | wtk1 | wtk1 |
| B1[2] | Triticum | turgidum | durum | + | + | Wtk1 | Wtk1 |
| B2[2] | Triticum | turgidum | durum | + | + | Wtk1 | Wtk1 |
| B9[2] | Triticum | turgidum | durum | + | + | Wtk1 | Wtk1 |
| B10[2] | Triticum | turgidum | durum | + | + | Wtk1 | Wtk1 |
| B70[2] | Triticum | turgidum | durum | + | + | Wtk1 | Wtk1 |
| 280-1[2] | Triticum | turgidum | durum | + | + | Wtk1 | Wtk1 |
| 280-2[2] | Triticum | turgidum | durum | + | + | Wtk1 | Wtk1 |
| Chinese Spring | Triticum | aestivum | | − | − | wtk1 | wtk1 |
| Fielder | Triticum | aestivum | | − | − | wtk1 | wtk1 |
| UCKern[3] | Triticum | aestivum | | − | − | wtk1 | wtk1 |
| Suncea[3] | Triticum | aestivum | | − | − | wtk1 | wtk1 |
| Kulin[3] | Triticum | aestivum | | − | − | wtk1 | wtk1 |
| Mexico708[3] | Triticum | aestivum | | − | − | wtk1 | wtk1 |
| Merav[3] | Triticum | aestivum | | − | − | wtk1 | wtk1 |
| Corrigin[3] | Triticum | aestivum | | − | − | wtk1 | wtk1 |
| Avocet S[3] | Triticum | aestivum | | − | − | wtk1 | wtk1 |

TABLE 12-continued

*Durum* and common wheat accessions evaluated for the presence of Wtk1 and wtk1. Each accession was categorized with gene-specific diagnostic markers for the two kinase-like domains (See Table 11).

| Germplasm number/ variety number | genus | species | sub-species | KinI Wtk1 | KinII Wtk1 | KinI | KinII |
|---|---|---|---|---|---|---|---|
| Excalibur[3] | Triticum | aestivum | | − | − | wtk1 | wtk1 |
| Stilleto[3] | Triticum | aestivum | | − | − | wtk1 | wtk1 |
| Baxter[3] | Triticum | aestivum | | − | − | wtk1 | wtk1 |
| Combat[3] | Triticum | aestivum | | − | − | wtk1 | wtk1 |
| Sapphire[3] | Triticum | aestivum | | − | − | wtk1 | wtk1 |
| Shenton[3] | Triticum | aestivum | | − | − | wtk1 | wtk1 |
| Ruby[3] | Triticum | aestivum | | − | − | wtk1 | wtk1 |
| HSB 2527[3] | Triticum | aestivum | | − | − | wtk1 | wtk1 |
| UCKern[3] | Triticum | aestivum | | − | − | wtk1 | wtk1 |
| UC1037[3] | Triticum | aestivum | | − | − | wtk1 | wtk1 |
| UC1041[3] | Triticum | aestivum | | − | − | wtk1 | wtk1 |
| UC1128[3] | Triticum | aestivum | | − | − | wtk1 | wtk1 |
| UC1107[3] | Triticum | aestivum | | − | − | wtk1 | wtk1 |
| UC1358[3] | Triticum | aestivum | | − | − | wtk1 | wtk1 |
| UC1110[3] | Triticum | aestivum | | − | − | wtk1 | wtk1 |
| Sel07-97[3] | Triticum | aestivum | | + | + | Wtk1 | Wtk1 |
| Sel46[3] | Triticum | aestivum | | + | + | Wtk1 | Wtk1 |
| Sel32[3] | Triticum | aestivum | | + | + | Wtk1 | Wtk1 |
| Sel20[3] | Triticum | aestivum | | + | + | Wtk1 | Wtk1 |
| Sel4[3] | Triticum | aestivum | | + | + | Wtk1 | Wtk1 |
| Sel7[3] | Triticum | aestivum | | + | + | Wtk1 | Wtk1 |
| V763[3] | Triticum | aestivum | | + | + | Wtk1 | Wtk1 |
| HSB 3177[3] | Triticum | aestivum | | + | + | Wtk1 | Wtk1 |
| HSB 2944[3] | Triticum | aestivum | | + | + | Wtk1 | Wtk1 |
| HSB 2408[3] | Triticum | aestivum | | + | + | Wtk1 | Wtk1 |
| HSB 2949[3] | Triticum | aestivum | | + | + | Wtk1 | Wtk1 |
| Suncea + Yr15[3] | Triticum | aestivum | | + | + | Wtk1 | Wtk1 |
| Kunlin + Yr15[3] | Triticum | aestivum | | + | + | Wtk1 | Wtk1 |
| Corrigin + Yr15[3] | Triticum | aestivum | | + | + | Wtk1 | Wtk1 |
| Stilleto + Yr15[3] | Triticum | aestivum | | + | + | Wtk1 | Wtk1 |
| UCKern + Yr15[3] | Triticum | aestivum | | + | + | Wtk1 | Wtk1 |
| UC1041 + Yr15[3] | Triticum | aestivum | | + | + | Wtk1 | Wtk1 |
| UC1107 + Yr15[3] | Triticum | aestivum | | + | + | Wtk1 | Wtk1 |
| UC1110 + Yr15[3] | Triticum | aestivum | | + | + | Wtk1 | Wtk1 |
| UC1128 + Yr15[3] | Triticum | aestivum | | + | + | Wtk1 | Wtk1 |
| UC1358 + Yr15[3] | Triticum | aestivum | | + | + | Wtk1 | Wtk1 |
| UC1037 + Yr15[3] | Triticum | aestivum | | + | + | Wtk1 | Wtk1 |
| Bobwhite + Yr15 | Triticum | aestivum | | + | + | Wtk1 | Wtk1 |
| Excalibur + Yr15[3] | Triticum | aestivum | | + | + | Wtk1 | Wtk1 |
| Avocet + Yr15[3] | Triticum | aestivum | | + | + | Wtk1 | Wtk1 |

[1] *T. durum* lines from the Salamini collection.
[2,3] The pedigrees of the Yr15 introgression lines, as well as their recurrent lines ([2] *T. turgidum* sp. *durum* and [3] *T. aestivum*) are known in the art.

Most of the previously cloned wheat resistance genes belong to the CC-NBS-LRR class. Therefore, the cloning of Yr15 encoding a protein with two tandem kinases broadens the tools available to diversify the sources of disease resistance in this economically important group of species. Moreover, the tandem kinases encoded by Yr15 are highly divergent from other tandem kinases involved in disease resistance in these species, including the barley stem rust resistance gene RPG1 and the true loose smut resistance candidate gene Un8.

Example 5: The TKP Protein Family is Found Across the Plant Kingdom

The occurrence of functional resistance genes with a tandem kinase structure (WTK1 and RPG1), as well as of many WTK1 orthologs and paralogs in wheat and its near relatives, motivated us to search for similar protein architectures across the plant kingdom. Altogether, we found 92 predicted proteins that are composed of putative kinase and pseudokinase domains in tandem; like WTK1, none had additional conserved domains. Most of the putative kinase domains share key conserved residues (FIG. 12A-12B; Table 13), while the putative pseudokinase domains are generally highly divergent in these positions, suggesting that they probably have no or impaired kinase activity (FIG. 12A; Table 14). The least conserved residues in the putative pseudokinase domains were found in the catalytic loop ($D^{166}$ and $D^{184}$) and the glycine-rich phosphate binding loop ($G^{52}$) (FIG. 12A). Analyses of motifs shared between putative kinase domains of TKP family members revealed additional conserved residues in sequences neighboring the core motifs (FIG. 12B). These results indicate that the putative kinase domains in this protein family may share a common structure.

The phylogenetic analysis showed that all 184 putative kinase and pseudokinase domains of the 92 predicted proteins could be sorted into 11 major clades and two singletons (FIG. 13A). Homology-based comparisons of the individual kinase domains of the 92 TKPs with the annotated *Arabidopsis* kinome families revealed clear relationships between the 11 clades and specific *Arabidopsis* families or subfamilies (FIG. 13A). Members of clades 1-10 and cluster 11.2 were found to correspond to five families of plant receptor-like kinases (RLK): concanavalin A-like lectin protein kinases (L-LPK), leucine-rich-repeat receptor kinases (LRR), receptor-like cytoplasmic kinases (RLCK), other kinases with no published family (RK), and cell-wall-associated kinases (WAK). Members of cluster 11.1 were not classified as RLKs. Instead, they were found to be associated with the following families of soluble kinases: cATP- cGTP- and phospholipid-dependent kinases (AGC), cyclin dependent kinases (CDK), raf-like MAPK kinase kinase (MAP3K-raf), MAPK kinase kinase (MAP3K) and SNF1-related kinase 3 (SnRK3). All 92 TKPs can be divided into two distinct groups based on the topology of the phylogenetic tree: (i) two kinase domains of the same gene that are clustered together in the same branch most likely resulted from a duplication event; (ii) two kinase domains belonging to the same gene but are positioned on separate branches represent a gene fusion event (FIG. 13A). While four clades (2, 5, 7, 11) included proteins that, by this criterion, resulted from either gene duplications or fusions, three clades (6, 9, 10) included proteins that originated only from duplication events, and four clades (1, 3, 4, 8) included proteins that resulted only from fusion events. A total of 52 TKPs were derived from duplication (occurring in kinase domains associated with 10 different families or subfamilies) and the other 40 proteins resulted from gene fusions (represented by 10 combinations of domains belonging to different families or subfamilies; FIG. 13B). The most common domains present in TKPs were similar to WAK kinases (63 out of 184) and LRR_8B (cysteine-rich kinases; 49 out of 184). WTK1 appears to be derived from a fusion of WAK and RLCK_8 kinase domains. Interestingly, most fusion events were found in monocot TKPs. Notably, clade 6 includes proteins of distant species and was presumably originated from a single ancient duplication event of a kinase in the L-LPK family before the divergence of the monocots and eudicots.

TABLE 13

The presence of key conserved residues in the putative kinase domains of the predicted proteins for 92 TKP sequences.

| Name of the predicted protein* | SEQ ID NO: | $G^{52}$ | $K^{72}$ | $E^{91}$ | $H^{158}$ | $H^{164}$ | $D^{166}$ | $N^{171}$ | $D^{184}$ |
|---|---|---|---|---|---|---|---|---|---|
| WTK1_K1 | 2 | G | K | E | H | H | D | N | D |
| RPG1_K2 | 123 | G | K | E | H | H | D | N | D |
| TraesCS1A01G061500.1_K1 | 124 | G | K | E | H | H | D | N | D |
| TraesCS1A01G197000.2_K1 | 125 | G | K | E | H | H | D | N | D |
| TraesCS1A01G432400.1_K1 | 126 | G | K | E | H | H | D | N | D |
| TraesCS1B01G079900.1_K1 | 127 | G | K | E | H | H | D | N | D |
| TraesCS1D01G033500.1_K1 | 128 | G | K | E | H | H | D | N | D |
| TraesCS2A01G510300.1_K1 | 129 | G | K | E | H | H | D | N | D |
| TraesCS2B01G538000.1_K1 | 130 | G | K | E | H | H | D | N | D |
| TraesCS2B01G538200.1_K1 | 131 | G | K | E | H | H | D | N | D |
| TraesCS2D01G123700.1_K1 | 132 | G | K | E | H | C | E | D | L |
| TraesCS2D01G124300.1_K1 | 133 | G | K | E | H | C | E | D | L |
| TraesCS2D01G511500.1_K1 | 134 | G | K | E | H | H | D | N | D |
| TraesCS2D01G579800.3_K1 | 135 | G | K | E | H | H | D | N | D |
| TraesCS3B01G579200.1_K1 | 136 | G | K | E | H | H | D | N | D |
| TraesCS4A01G334900.1_K1 | 137 | G | K | E | H | H | D | N | D |
| TraesCS4A01G335000.1_K1 | 138 | G | K | E | H | H | D | N | D |
| TraesCS5A01G161500.1_K1 | 139 | G | K | E | H | H | D | N | D |
| TraesCS5A01G241300.2_K1 | 140 | G | K | E | H | H | D | N | D |
| TraesCS5A01G449800.1_K1 | 141 | G | K | E | H | H | D | N | D |
| TraesCS5B01G005400.3_K1 | 142 | G | K | E | H | H | D | N | D |
| TraesCS5B01G159000.1_K1 | 143 | G | K | E | H | H | D | N | D |
| TraesCS5B01G239600.1_K1 | 144 | G | K | E | H | H | D | N | D |
| TraesCS5D01G166400.1_K1 | 145 | G | K | E | H | H | D | N | D |
| TraesCS5D01G241800.1_K1 | 146 | G | K | E | L | H | D | N | D |
| TraesCS5D01G247800.1_K1 | 147 | G | K | E | H | H | D | N | D |
| TraesCS5D01G459500.1_K1 | 148 | G | K | E | H | H | D | N | D |
| TraesCS5D01G459700.1_K1 | 149 | G | K | E | H | H | D | N | N |
| TraesCS5D01G537200.1_K1 | 150 | G | K | E | H | H | D | N | D |
| TraesCS6A01G020100.1_K1 | 151 | G | K | E | H | H | D | N | D |
| TraesCS6A01G036400.1_K1 | 152 | G | K | E | H | H | D | N | D |
| TraesCS6B01G029600.1_K1 | 153 | G | K | E | H | H | D | N | D |
| TraesCS6B01G050800.1_K1 | 154 | G | K | E | H | H | D | N | D |
| TraesCS6B01G050900.1_K1 | 155 | G | K | E | H | H | D | N | D |
| TraesCS6B01G051000.1_K1 | 156 | G | K | E | D | H | D | N | D |
| TraesCS6D01G025700.1_K1 | 157 | G | K | E | H | H | D | N | D |
| TraesCS6D01G042200.1_K1 | 158 | G | K | E | H | H | D | N | D |
| TraesCS6D01G042300.1_K1 | 159 | G | K | E | H | H | D | N | D |
| TraesCS7B01G048900.1_K1 | 160 | G | K | E | H | H | D | N | D |
| TraesCS7D01G147900.1_K1 | 161 | G | K | E | H | H | D | N | D |
| MLOC_K1 | 162 | G | K | E | H | H | D | N | D |
| HORVU1Hr1G011660.17_K1 | 163 | G | K | E | H | H | D | N | D |
| HORVU1Hr1G051220.15_K1 | 164 | G | K | E | H | H | D | N | D |
| HORVU5Hr1G050470.1_K1 | 165 | G | K | E | H | H | D | N | D |
| HORVU5Hr1G107460.3_K1 | 166 | G | K | E | H | H | D | N | D |
| HORVU6Hr1G003940.7_K1 | 167 | G | K | E | H | H | D | N | D |
| HORVU6Hr1G025940.2_K1 | 168 | G | K | E | H | H | D | N | D |
| HORVU7Hr1G001450.11_K2 | 169 | G | K | E | H | H | D | N | D |
| HORVU7Hr1G001600.12_K2 | 170 | G | K | E | H | H | D | N | D |
| Sc1Loc00250465.1_K1 | 171 | G | K | E | H | H | D | N | D |
| Sc5Loc01920045.3_K1 | 172 | G | K | E | Y | H | D | N | D |

TABLE 13-continued

The presence of key conserved residues in the putative kinase
domains of the predicted proteins for 92 TKP sequences.

| Name of the predicted protein* | SEQ ID NO: | $G^{52}$ | $K^{72}$ | $E^{91}$ | $H^{158}$ | $H^{164}$ | $D^{166}$ | $N^{171}$ | $D^{184}$ |
|---|---|---|---|---|---|---|---|---|---|
| Sc2Loc00020948.6_K1 | 173 | G | K | E | H | H | D | N | D |
| Os01t0310500-01_K1 | 174 | G | K | E | H | H | D | N | D |
| Os07t0493200-01_K1 | 175 | G | K | E | H | H | D | N | D |
| Os07t0493800-00_K1 | 176 | G | K | E | H | H | D | N | D |
| Os07t0494300-00_K1 | 177 | G | K | E | H | H | D | N | D |
| Os10t0141200-00_K1 | 178 | G | K | E | H | H | D | N | D |
| Os10t0143866-00_K1 | 179 | G | K | E | H | H | D | N | D |
| Os11t0173432-00_K1 | 180 | G | K | E | H | H | D | N | D |
| Os11t0445300-01_K1 | 181 | G | K | E | H | H | D | N | D |
| Os11t0553500-00_K1 | 182 | G | K | E | H | H | D | N | D |
| Os11t0556400-00_K1 | 183 | G | K | E | H | H | D | N | D |
| AQK57443.1_K2 | 184 | G | K | E | H | H | D | N | D |
| AQK57450.1_K2 | 185 | G | K | E | H | H | D | N | D |
| AQK57451.1_K1 | 186 | G | K | E | H | H | D | N | D |
| AQK57454.1_K2 | 187 | G | K | E | H | H | D | N | D |
| AQK58522.1_K1 | 188 | G | K | E | H | H | N | N | D |
| AQK90211.1 K1 | 189 | G | K | E | H | H | D | N | D |
| AQK92446.1 K1 | 190 | G | K | E | H | H | D | N | D |
| ONM26931.1_K1 | 191 | G | K | E | H | H | D | N | D |
| AT2G32800.1_K1 | 192 | G | K | E | H | H | D | N | D |
| Pp1s31_26V6.1_K2 | 193 | G | K | E | H | H | D | N | D |
| PGSC0003DMP400002294_K2 | 194 | G | K | E | H | H | D | N | D |
| BnaA07g14690D_K1 | 195 | G | K | E | H | H | D | N | D |
| BnaA09g41440D_K1 | 196 | G | K | E | H | H | D | N | D |
| BnaC04g38500D_K1 | 197 | G | Y | E | H | Y | D | N | D |
| BnaA03g15120D_K1 | 198 | G | K | E | H | H | D | N | D |
| BnaA02g06510D_K1 | 199 | G | K | E | H | H | D | N | D |
| Potri.017G055000_K1 | 200 | G | K | E | H | H | D | N | D |
| Potri.001G315000_K1 | 201 | G | K | E | H | H | D | N | D |
| SOBIC.010G171600.1.P_K1 | 202 | G | K | E | H | H | D | N | D |
| SOBIC.005G096400.1.P_K1 | 203 | G | K | E | H | H | N | N | D |
| SOBIC.008G022300.2.P_K1 | 204 | G | K | E | H | H | D | N | D |
| SOBIC.001G353800.1.P_K1 | 205 | G | K | E | H | H | D | N | D |
| SOBIC.008G148200.2.P_K1 | 206 | G | K | E | H | H | D | N | D |
| SOBIC.010G028950.1.P_K1 | 207 | G | K | E | H | H | D | N | D |
| SOBIC.005G154100.1.P_K1 | 208 | G | K | E | H | H | D | N | D |
| SOBIC.009G246800.1.P_K1 | 209 | G | K | E | H | H | D | N | D |
| SOBIC.005G155100.1.P_K1 | 210 | G | K | E | H | H | D | N | D |
| SOBIC.005G154800.1.P_K1 | 211 | G | K | E | H | H | D | N | D |
| SOBIC.005G060700.2.P_K1 | 212 | G | K | E | H | H | D | N | D |
| SOBIC.001G354100.2.P_K1 | 213 | G | K | E | H | H | D | N | G |
| HORVU1Hr1G051210.14 | 214 | G | K | E | H | H | D | N | D |

*The predicted proteins are named according to the gene models in the respective genome assemblies. Suffix K1/2 marks the position of the putative kinase domain within the tandem kinase-pseudokinase structure relative to the 5'-end.

TABLE 14

The presence of key conserved residues in the putative pseudokinase
domains of the predicted proteins for 92 TKP sequences.

| Name of the predicted protein* | $G^{52}$ | $K^{72}$ | $E^{91}$ | $H^{158}$ | $H^{164}$ | $D^{166}$ | $N^{171}$ | $D^{184}$ |
|---|---|---|---|---|---|---|---|---|
| TraesCS1A01G061500.1_K2 | S | N | K | H | H | N | K | D |
| TraesCS1A01G197000.2_K2 | G | K | I | H | H | D | N | N |
| TraesCS1A01G432400.1_K2 | G | R | E | N | C | N | N | D |
| TraesCS1B01G079900.1_K2 | S | K | K | H | H | N | K | D |
| TraesCS1D01G033500.1_K2 | G | S | S | H | H | N | T | D |
| TraesCS2A01G510300.1_K2 | G | K | L | H | H | N | N | E |
| TraesCS2B01G538000.1_K2 | G | K | H | H | H | N | N | E |
| TraesCS2B01G538200.1_K2 | G | K | H | H | H | N | N | E |
| TraesCS2D01G123700.1_K2 | G | Q | M | H | S | K | N | D |
| TraesCS2D01G124300.1_K2 | G | K | D | H | S | K | N | D |
| TraesCS2D01G511500.1_K2 | — | K | H | H | H | N | N | E |
| TraesCS2D01G579800.3_K2 | G | K | E | H | H | D | N | G |
| TraesCS3B01G579200.1_K2 | G | K | G | H | H | S | N | G |
| TraesCS4A01G334900.1_K2 | S | K | E | H | H | D | S | G |
| TraesCS4A01G335000.1_K2 | G | R | E | H | H | R | S | D |
| TraesCS5A01G161500.1_K2 | L | K | E | H | H | N | A | S |
| TraesCS5A01G241300.2_K2 | G | K | E | H | F | D | H | G |

TABLE 14-continued

The presence of key conserved residues in the putative pseudokinase domains of the predicted proteins for 92 TKP sequences.

| Name of the predicted protein* | $G^{52}$ | $K^{72}$ | $E^{91}$ | $H^{158}$ | $H^{164}$ | $D^{166}$ | $N^{171}$ | $D^{184}$ |
|---|---|---|---|---|---|---|---|---|
| TraesCS5A01G449800.1_K2 | G | K | E | H | P | D | N | E |
| TraesCS5B01G005400.3_K2 | G | K | E | H | H | N | N | D |
| TraesCS5B01G159000.1_K2 | L | K | E | H | H | N | A | S |
| TraesCS5B01G239600.1_K2 | G | K | E | H | V | D | N | G |
| TraesCS5D01G166400.1_K2 | L | K | E | H | H | N | A | S |
| TraesCS5D01G241800.1_K2 | G | K | R | H | H | N | N | E |
| TraesCS5D01G247800.1_K2 | G | K | E | H | V | D | N | D |
| TraesCS5D01G459500.1_K2 | S | K | E | H | P | V | N | S |
| TraesCS5D01G459700.1_K2 | A | K | K | H | P | V | N | A |
| TraesCS5D01G537200.1_K2 | G | K | Q | H | H | D | N | D |
| TraesCS6A01G020100.1_K2 | L | K | E | H | H | C | N | Y |
| TraesCS6A01G036400.1_K2 | D | K | E | K | H | N | N | N |
| TraesCS6B01G029600.1_K2 | G | K | E | H | H | G | N | W |
| TraesCS6B01G050800.1_K2 | D | R | E | H | H | D | N | G |
| TraesCS6B01G050900.1_K2 | D | R | E | H | H | N | N | D |
| TraesCS6B01G051000.1_K2 | G | R | E | H | H | D | N | D |
| TraesCS6D01G025700.1_K2 | G | K | E | H | H | G | N | W |
| TraesCS6D01G042200.1_K2 | G | K | E | H | H | N | N | D |
| TraesCS6D01G042300.1_K2 | D | R | E | H | H | D | N | D |
| TraesCS7B01G048900.1_K2 | C | N | S | H | G | N | N | — |
| TraesCS7D01G147900.1_K2 | C | N | S | H | G | N | N | G |
| WTK1_K2 | S | K | K | H | H | N | K | G |
| MLOC_K2 | G | K | E | H | H | D | N | D |
| RPG1_K1 | G | K | E | H | H | E | K | G |
| HORVU1Hr1G011660.17_K2 | D | K | E | H | H | N | N | G |
| HORVU1Hr1G051220.15_K2 | G | K | I | H | H | D | N | N |
| HORVU5Hr1G050470.1_K2 | L | K | E | H | H | N | A | S |
| HORVU5Hr1G107460.3_K2 | G | K | E | H | P | D | N | K |
| HORVU6Hr1G003940.7_K2 | D | K | E | H | H | G | S | Y |
| HORVU6Hr1G025940.2_K2 | G | K | E | H | H | N | N | D |
| HORVU7Hr1G001450.11_K1 | G | K | E | H | H | E | K | G |
| HORVU7Hr1G001600.12_K1 | — | — | E | H | H | G | K | G |
| Sc1Loc00250465.1_K2 | D | K | E | H | H | N | N | G |
| Sc5Loc01920045.3_K2 | G | K | Q | H | H | G | N | — |
| Sc2Loc00020948.6_K2 | G | K | H | H | H | N | N | E |
| Os01t0310500-01_K2 | E | K | T | H | H | N | N | N |
| Os07t0493200-01_K2 | C | K | E | H | H | N | N | G |
| Os07t0493800-00_K2 | R | K | E | H | H | D | N | G |
| Os07t0494300-00_K2 | C | K | E | H | H | D | D | G |
| Os10t0141200-00_K2 | S | K | Q | H | — | S | D | K |
| Os10t0143866-00_K2 | D | K | E | H | H | N | T | G |
| Os11t0173432-00_K2 | G | K | E | H | H | D | N | D |
| Os11t0445300-01_K2 | L | K | E | H | H | N | A | S |
| Os11t0553500-00_K2 | D | K | E | H | H | P | D | C |
| Os11t0556400-00_K2 | G | K | A | H | H | D | N | A |
| AQK57443.1_K1 | — | — | — | H | H | N | N | D |
| AQK57450.1_K1 | G | K | E | H | H | N | N | D |
| AQK57451.1_K2 | G | R | E | H | — | M | — | — |
| AQK57454.1_K1 | — | — | — | H | H | N | N | D |
| AQK58522.1 K2 | G | K | E | — | — | — | — | — |
| AQK90211.1 K2 | A | N | D | C | C | T | T | D |
| AQK92446.1_K2 | L | K | E | H | H | S | A | S |
| ONM26931.1_K2 | G | H | G | H | H | S | T | E |
| AT2G32800.1_K2 | V | K | E | H | H | N | T | G |
| Pp1s31_26V6.1_K1 | D | K | E | H | H | D | N | D |
| PGSC0003DMP400002294_K1 | G | K | E | H | H | D | K | D |
| BnaA07g14690D_K2 | G | K | E | H | H | D | N | D |
| BnaA09g41440D_K2 | G | K | E | H | H | D | N | D |
| BnaC04g38500D_K2 | G | K | K | H | Y | D | N | C |
| BnaA03g15120D_K2 | V | K | E | H | H | N | T | G |
| BnaA02g06510D_K2 | G | A | E | H | H | D | N | D |
| Potri.017G055000_K2 | V | K | E | H | H | N | S | N |
| Potri.001G315000_K2 | V | K | E | H | H | N | S | N |
| SOBIC.010G171600.1.P_K2 | G | K | E | H | H | D | N | D |
| SOBIC.005G096400.1.P_K2 | G | K | E | H | H | D | N | D |
| SOBIC.008G022300.2.P_K2 | D | R | E | C | H | N | C | I |
| SOBIC.001G353800.1.P_K2 | G | I | E | H | Y | N | D | D |
| SOBIC.008G148200.2.P_K2 | D | K | D | H | H | N | N | E |
| SOBIC.010G028950.1.P_K2 | G | V | T | Q | H | N | — | A |
| SOBIC.005G154100.1.P_K2 | G | H | E | H | H | S | T | E |
| SOBIC.009G246800.1.P_K2 | L | K | D | H | H | N | A | S |
| SOBIC.005G155100.1.P_K2 | G | R | E | H | H | Y | K | G |
| SOBIC.005G154800.1.P_K2 | G | R | E | H | H | S | T | E |

TABLE 14-continued

The presence of key conserved residues in the putative pseudokinase domains of the predicted proteins for 92 TKP sequences.

| Name of the predicted protein* | Key conserved residues | | | | | | | |
|---|---|---|---|---|---|---|---|---|
| | $G^{52}$ | $K^{72}$ | $E^{91}$ | $H^{158}$ | $H^{164}$ | $D^{166}$ | $N^{171}$ | $D^{184}$ |
| SOBIC.005G060700.2.P_K2 | G | K | E | H | H | N | N | D |
| SOBIC.001G354100.2.P_K2 | G | A | E | H | H | N | N | D |

*The predicted proteins are named according to the gene models in the respective genome assemblies. Suffix K½ marks the position of the putative pseudokinase domain within the tandem kinase-pseudokinase structure relative to the 5'-end.

Example 6: Further Characterization of Wtk1 Conferred Resistance

Some of the Yr15 introgression lines showed a partial resistance response when challenged with a few races that appeared in Europe more than a decade ago (e.g. Pst race DK92/02). However, we demonstrate here that pyramiding Yr15 with additional resistance genes, such as Yr5, provides full protection against races that are virulent or partially virulent on each one of them separately (FIG. 14). Furthermore, Yr15 is also effective against modern European races, including the 'Warrior' race (DK09/11), currently threatening European wheat production.

Microscopic observations of the interactions between host plant cells and invading pathogen structures showed substantially larger fungal colonies and much more abundant pathogen feeding structures in the susceptible common wheat cultivar Avocet S compared with its resistant (Avocet+Yr15) near isogenic line (NIL), 3-14 dpi (FIG. 15A-15G). Relative quantification of fungal development and colonization of Avocet S fitted well the standard logistic population growth model (P<10-15), which is typical for the accumulation of biomass in growth of microorganisms under favorable conditions, while colonization of Avocet+Yr15 did not differ significantly from 0 (P=0.21) (FIG. 15H). Fungal biomass residing within infected leaf tissues showed significant differences between NILs 7-14 dpi (P<0.001) (FIG. 15H), when hypersensitive responses (HR) on plant leaves became visible in Avocet+Yr15, but not in Avocet S (FIGS. 15A and 15I). These results suggest that HR is playing a central role in restricting the development of fungal feeding structures by Yr15.

Although the invention has been described in conjunction with specific embodiments thereof, it is evident that many alternatives, modifications, and variations will be apparent to those skilled in the art. Accordingly, it is intended to embrace all such alternatives, modifications and variations that fall within the spirit and broad scope of the appended claims.

SEQUENCE LISTING (235 sequences)

SEQ ID NO: 1 - DNA, 1998 bp, Triticum turgidum
atggattaccaaggaaacaattttaatgatttctttcaaactaatgggcattttgtacttaaaagagtggacaacaactataaactgcggtcattcactgaaaaggagatagagcacattacagacagatatagcacttcgcttggtaatggctcgttcggtgatgtctacaaaggaagattagacgatcaacgtccagtcgcagtaaagagatacaaaaatggaaccaagaaagaggagtttgccaaggaggtgatagtgcattcccagataaaccataagaacgttgtcagattgttaggctgctgcacagaggaaaatgctcttatgattgttatggagtttatctgtaatggaaacctctacaacatccttcactgtggcaatgcagatggtcctatccccttccctttggacaaacgtttggacatcgccatcgagtcagcggaagcactatcatgcatgcattcaatgtacagtcctgtccttcatggtgacattaaacctgccaatatactgttggatgaaaagtacttgccaaagctatctgattttggaatagcaagactgctttctactgatgaggcccagcgtaccaaaactgttattggttgcataggttatgtagaccctttgttttgtcagagcggtattctaactacaaagagtgatgtatacagttttggagttgttctgttggaaatgatcacccgaaaaaaagcgacggatggggctactagtcttactcaatgtttcgccgaggccctgggagggaagaaggtgagacaattgtttgatgtggaaattgccaatgacaagaagaaggtgaaattgatcgaagatattgcgaagttagcagctacatgcttgaaactggaggataaaatgcgtccgacaatggttgaggtagcagatagacttaggaggattagaaaagctctcccccagcgcaagggtgaaagctctacaggcatcaacaatgggctcataagaacaggaaaggcagaggatctaccaactatttcccttgatgaaatgaagaaactaacaagaaacttcagtgatggtgctctaataggagagagctcacaaggcagagttttgttcgaagagttaagttatggaaagagatatgcattcaagtcttctcaagaaattgatttgaagattgaagcaatttcaagactgaaacacaagaacgttgtccaacttctcggaaattgggtcgaaggaaacaaatatgttcttgcttacgagtatgtatcggggggcacgttgcatgatattcttcacagagagggtgataagggtgtcagtggagccaggccaggagcagctctatcatggatgcagagagtgaagattgccttaagtgcagcagaagggcttgagttcctccatcagaaggcagagcctcaggtcacccacggtaacatcatgtccagcaagatacttctctttgacaaagataatgcaaaggttggcggcgttggtatctccaatgtactggtgcgtgataacatggttcactgtcacagttttagacaggactgtgacatggatcgtatggatggtattcgttatcacccagatgattactatgtcgatctatatgctgctactggacagtgtaacgcaaagagcgatgtatacgccttcggggttgtgctgctggagcttttaaccggtcgcgaggcagttgatcatgcactacccaaaggcaagcagagcctcgtgacatgggtatacaaccatggcgaggagaaaagcccatggagatgggaaaacaatattatggaagacaatgtgttaacaaaaacaagttttagtgaagatatggtgcagcgatgcgtggatccaaggcttaaaggatattaccatcgcagtgctgttaccaagatgggtgcgatcgcgtcgctatgcgtgaattacaatccagatctccgaccaaacatgagcactgtcgtcaagggtctgaggcaattgttgcaaaagtga

SEQ ID NO: 2 - protein, 665 aa, Triticum turgidum
MDYQGNNFNDFFQTNGHFVLKRVDNNYKLRSFTEKEIEHITDRYSTSLGNGSFGDVYKGRLDDQRPVAVKRYKNGTKKEEFAKEVIVHSQINHKNVVRLLGCCTEENALMIVMEFICNGNLYNILHCGNADGPIPFPLDKRLDIAIESAEALSCMHSMYSPVLHGDIKPANILLDEKYLPKLSDFGIARLLSTDEAQRTKTVIGCIGYVDPLFCQSGILTTKSDVYSFGVVLLEMITRKKATDGATSLTQCFAEALGGKKVRQLFDVEIANDKKKVKLIEDIAKLAATCLKLEDKMRPTMVEVADRLRRIRKALPQRKGESSTGINNGLIRTGKAEDLPTISLDEMKKLTRNFSDGALIGESSQGRVLFEELSYGKRYAFKSSQEIDLKIEAISRLKHKNVVQLLGNWVEGNKYVLAYEYVSGGTLHDILHREGDKGVSGARPGAALSWMQRVKIALSAAEGLEFLHQKAEPQVTHGNIMSSKILLFDKDNAKVGGVGISNVLVRDNMVHCHSFRQDCDMDRMDGIRYHPDDYYVDLYAATGQCNAKSDVYAFGVVLLELLTGREAVDHALPKGKQSLVTWVYNHGEEKSPWRWENNIMEDNVLTKTSFSEDMVQRCVDPRLKGYYHRSAVTKMGAIASLCVNYNPDLRPNMSTVVKGLRQLLQK

SEQ ID NO: 3 - DNA, 4657 bp, Triticum turgidum
atggattaccaaggaaacaattttaatgatttctttcaaactaatgggcattttgtacttaaaagagtggacaacaactataaactgcggtcattcactgaaaaggagatagagcacattacagacagatatagcacttcgcttggtaatggctcgttcggtgatgtctacaaaggaagattagacgatcaacgtccagtcgcagtaaagagatacaaaaatggaaccaagaaagaggagtttgccaaggaggtgatagtgcattcccagataaaccataagaacgttgtcagattgttaggctgctgcacagaggaaaatgctcttatgattgttatggagtttatctgtaatggaaacctctacaacatccttcactgtggcaatgcagatggtcctatccccttccctttggacaaacgtttggacatcgccatcgagtcagcggaagcactatcatgcatgcattcaatgtacagtcctgtccttcatggtgacattaaacctgccaatatactgttggatgaaaagtacttgccaaagctatctgattttggaatagcaagactgctttctactgatgaggcccagcgtaccaaaactgttattggttgcataggttatgtagaccctttgttttgtcagagcggtattctaactacaaagagtgatgtatacagttttggagttgttctgttggaaatgatcacccgaaaaaaagcgacggatggggctactagtcttactcaatgtttcgccgaggccctgggagggaagaaggtgagacaattgtttgatgtggaaattgccaatgacaagaagaaggtgaaattgatcgaagatattgcgaagttagcagctacatgcttgaaactggaggataaaatgcgtccgacaatggttgaggtagcagatagacttaggaggattagaaaagctctcccccagcgcaagggtgaaagctctacaggtaattaagaagagtaaaatgcattggcagtcactgctctacttcaaagtttacgtggctttttgcttagctactgatgtcagacgtggataacaacacggtatatgcagtagggtgggatgcgaaataaacaaaccttagctgcttctttttaatactttgtttatgtgtaggattacgcacaagtaatttcagtacttgtttgggtgaaaggaaaaatacacaaacttttattttcttcttttaagcacttaagtactcaaatacttcctttgtccagtgtgggagtgtcaaaaaacgtcttacgttatgggacggagggagtacatgaatatagccttcgtaggtaatttaagaaattatccttttcctgttagcatggccatttaacgaaattcttttcctttcaactatgttaggtctgtagtctccttagttgtttctgtatgtattgaatcgttttagactaaagtgcatggaatgtttaaaaatcttagtttgagtacatacgtggagttttaaggtacctcatgcattttacttttctttttaagtatattatacaattttaagtataagtagtcggacccttccccggaccctgcgctagcaggagctacatgcaatgggctgccctttttttttataagagtggactcatcaaaatgaatattatgtatatttaggttaaagacgaaccagtttgccaaaataaatgtactggttcagaagggtacatgccacccttgttttcattcccaatccttgtgtgctaccagggttcatgtccatgccaatcacataaaacacaatttactctaagcgtgtcacaaatcataagtaatgaaactttacctcactagtaaatctgtacgtgcaatgcatgttgatattaggcaaatatattaattgcacgcggatattaggtagggtattatttgcgtgtttattatgggattagcattgttatttatatttgaatgatattaactgcatgctaaacgtgttgagtgctcaccattgcggagcagcctaagtcgttggattgacctagattgatggccgagatttgttggatctgcccctttgggtctttttatattgatgatatagatagatatagattatatgagaccgttatttatttatgtcttccccaatgcaggcatcaacaatgggctcataagaacaggaaaggcagaggatctaccaactatttcccttgatgaaatgaagaaactaacaagaaacttcagtgatggtgctctaataggagagagctcacaaggcagagttttgttcgaagagttaagttatggaaagagatatgcattcaagtcttctcaagaaattgatttgaaggttatggttccgagccttaccttttcaccatttctactgacactcttcatttattagtacagaaaggtcttgccttctaactggcacatttccgtggcagattgaagcaatttcaagactgaaacacaagaacgttgtccaacttctcggaaattgggtcgaaggaaacaaatatgttcttgcttacgagtatgtatcggggggcacgttgcatgatattcttcacagagagggtgaggaactatacaattttactttttcggagtaacatgctgcatgccttttttattgaaagggggaatagtttggcaattcaacgtcagccatgtgaggaacagagcaacactcaaaagagctcgcctcctacgaaaccttaaattttcaaaaaaatagtttagtgcgtctggtatgtgaggcggggacatattttgttaacatcacttacctgctttgaatatacaatatgataaaagtaaaaatttctccaatattattctggtttatggtcacaggtgataagggtgtcagtggagccaggccaggagcagctctatcatggatgcagagagtgaagattgccttaagtgcagcagaagggcttgagttcctccatcagaaggcagagcctcaggtcacccacggtaacatcatgtccagcaagatacttctctttgacaaagataatgcaaaggttggcggcgttggtatctccaatgtactggtgcgtgataacatggttcactgtcacagttttagacaggactgtgacatggatcgtatggatggtattcgttatcacccagatgattactatgtcgatctatatgctgctactggacagtgtaacgcaaagagcgatgtatacgccttcggggttgtgctgctggagcttttaaccggtcgcgaggcagttgatcatgcactacccaaaggcaagcagagcctcgtgacatgggtatacaaccatggcgaggagaaaagcccatggagatgggtatgcatccgtgtattcattgattcgtgtgtataatgtcttgacaaggtgcattagctaaactattgatgactttgatgcacaggaaaacaatattatggaagacaatgtgttaacaaaaacaagttttagtgaagatatggtgcagcgatgcgtggatccaaggcttaaaggatattaccatcgcagtgctgttaccaaggtatgtaatttatcctgaactctaccatgtttaagtttaaccgagtaaactagtggtgaatcctgggcaatggtgcggggagatatcattttcgaaccattgtagtctattccaccaaataagcaggatttaatctccattattatactccctctgtctcataatataagacgttgatgtaataacgtcttatgttatggcacagaaggagtaagagttaattcaacattttagccccaagtttgtcagggtaccccctgttctaaattcaattcggaccatcttgtaccacaaagtttcaaatttgttcaccaccgggaagggaagaagtagtagccccacaatcctgcgttggtcctcttcatcatggctcctcccgatctcatcatggcccatcgcttcgcacggtcactgctcttcccatgtcagtcttgctatgcggcagtaagttggcacgccacctcagcctaacagcgggtctgggctgctataagagtgggaatttctcctggggtaaataccagtacaaatttgaaaactgaggataaatcttctgggaacaaagataaactcactcgtgtgaagagcatccagtgaggcaaagaaaaccggtaatctattgcacaaaaagcttcacaggaagcaacgacaatcaatccaggtaacatgttaagactatgcaggaggcaaacaagtgacatgaacacttgtgcaaacagctccaggaagcctattcatcaggaaccgctccagaaccgccatcttgattaatagcgtacagtgcattaagccttgaaggaaccgtgaccaccctcctttggcttgagattgtctttttgagtttcaccagccgtgctgctccttgtttcatatccttctgcattacagaaattagcgcgttataatcttgattgaatgactagctagggggtaaaaagatgaaactaagttttagtataatctttgagttcttgagctatgagggaccaagtgactgctctcctgattactttcttcttttggcaagcagatgggtgcgatcgcgtcgctatgcgtgaattacaatccagatctccgaccaaacatgagcactgtcgtcaagggtctgaggcaattgttgcaaaagtga

SEQ ID NO: 4 - protein, 269 aa, Triticum turgidum
DRYSTSLGNGSFGDVYKGRLDDQRPVAVKRYKNGTKKEEFAKEVIVHSQINHKNVVRLLGCCTEENALMIVMEFICNGNLYNILHCGNADGPIPFPLDKRLDIAIESAEALSCMHSMYSPVLHGDIKPANILLDEKYLPKLSDFGIARLLSTDEAQRTKTVIGCIGYVDPLFCQSGILTTKSDVYSFGVVLLEMITRKKATDGATSLTQCFAEALGGKKVRQLFDVEIANDKKKVKLIEDIAKLAATCLKLEDKMRPTMVEVADRLRRI

SEQ ID NO: 5 - protein, 306 aa, Triticum turgidum
GESSQGRVLFEELSYGKRYAFKSSQEIDLKIEAISRLKHKNVVQLLGNWVEGNKYVLAYEYVSGGTLHDILHREGDKGVSGARPGAALSWMQRVKIALSAAEGLEFLHQKAEPQVTHGNIMSSKILLFDKDNAKVGGVGISNVLVRDNMVHCHSFRQDCDMDRMDGIRYHPDDYYVDLYAATGQCNAKSDVYAFGVVLLELLTGREAVDHALPKGKQSLVTWVYNHGEEKSPWRWENNIMEDNVLTKTSFSEDMVQRCVDPRLKGYYHRSAVTKMGAIASLCVNYNPDLRPNMSTVVKGLRQLLQK

SEQ ID NO: 6 - DNA, 808 bp, Triticum turgidum
gacagatatagcacttcgcttggtaatggctcgttcggtgatgtctacaaaggaagattagacgatcaacgtccagtcgcagtaaagagatacaaaaatggaaccaagaaagaggagtttgccaaggaggtgatagtgcattcccagataaaccataagaacgttgtcagattgttaggctgctgcacagaggaaaatgctcttatgattgttatggagtttatctgtaatggaaacctctacaacatccttcactgtggcaatgcagatggtcctatccccttccctttggacaaacgtttggacatcgccatcgagtcagcggaagcactatcatgcatgcattcaatgtacagtcctgtccttcatggtgacattaaacctgccaatatactgttggatgaaaagtacttgccaaagctatctgattttggaatagcaagactgctttctactgatgaggcccagcgtaccaaaactgttattggttgcataggttatgtagaccctttgttttgtcagagcggtattctaactacaaagagtgatgtatacagttttggagttgttctgttggaaatgatcacccgaaaaaaagcgacggatggggctactagtcttactcaatgtttcgccgaggccctgggagggaagaaggtgagacaattgtttgatgtggaaattgccaatgacaagaagaaggtgaaattgatcgaagatattgcgaagttagcagctacatgcttgaaactggaggataaaatgcgtccgacaatggttgaggtagcagatagacttaggaggatta

SEQ ID NO: 7 - DNA, 924 bp, Triticum turgidum
ataggagagagctcacaaggcagagttttgttcgaagagttaagttatggaaagagatatgcattcaagtcttctcaagaaattgatttgaagattgaagcaatttcaagactgaaacacaagaacgttgtccaacttctcggaaattgggtcgaaggaaacaaatatgttcttgcttacgagtatgtatcggggggcacgttgcatgatattcttcacagagagggtgataagggtgtcagtggagccaggccaggagcagctctatcatggatgcagagagtgaagattgccttaagtgcagcagaagggcttgagttcctccatcagaaggcagagcctcaggtcacccacggtaacatcatgtccagcaagatacttctctttgacaaagataatgcaaaggttggcggcgttggtatctccaatgtactggtgcgtgataacatggttcactgtcacagttttagacaggactgtgacatggatcgtatggatggtattcgttatcacccagatgattactatgtcgatctatatgctgctactggacagtgtaacgcaaagagcgatgtatacgccttcggggttgtgctgctggagcttttaaccggtcgcgaggcagttgatcatgcactacccaaaggcaagcagagcctcgtgacatgggtatacaaccatggcgaggagaaaagcccatggagatgggaaaacaatattatggaagacaatgtgttaacaaaaacaagttttagtgaagatatggtgcagcgatgcgtggatccaaggcttaaaggatattaccatcgcagtgctgttaccaagatgggtgcgatcgcgtcgctatgcgtgaattacaatccagatctccgaccaaacatgagcactgtcgtcaagggtctgaggcaattgttgcaaaagtga

SEQ ID NO: 8 - DNA, 9287 bp, Triticum turgidum
gcgttgctgctccctcagcctctccttccgcacccctcttatcaagtgtcggccggagcaatcagaagcagctagctaggctagctaacacgtcgtcggccttctcaaaccaggccgtcgtcggccggatatcgtctcaggccgtggtatgtatccgcagctctcttccctttttgatttgatcttactttgctggttcgatattattttttctgcgaccacaatcctctttttgataggctagacccctttcattagtaaggaaatcaaagttgtacctcgtcggccaccccttgaatagcagccagtccagcaaacgaacttaacaaccgagcgaactgaagctcaaaacaaggctgtctaaattctaaagtaaaacaacccagacagggctgctagtttctctttcttgggatccaagggctacagctttctaccagcttgatagacttcagccgtgacctgttccagtacttttgcgcacatgtctgcagttttagagatatttagcggatgaggactaaagagcaatgttcatgacttcaagatccaagatccccagcccaccatgatcctttggcaaacagacccgaggccggtttgtcaagtgacatttccttttggttttgtccgcactctttctctctctctctctctatatatatatatatagcaactattacattagaatgctttgaatccaaaattcaagaactacaaagtagctcatacaactaagaattacgacgaaacttgttgaagatatcttacgacgaaacttcttaatattagttgtactcgaagaataaaattggtttttaatttcggaaaaggtcaaatattttgtctttctgcgattgttccatcaatttaatgtagagttttgttattctcaagcatatttcaatactgccaatttatgtttggtgactgaccgacaggtgtggtgtacaaagttttactcaaagatcaactatataatcttttttggtgccataagatggagctcccacgaaacaaacttgcagatttgaaccaaggaaatgaaaatttaaaggcaaaggcaaagtggacacccaatgccaggaggttcacagaacatcagattaaaagaattactaagaactatagaactcatgttggcaaaggtgcctttggtgaggttttccgaggttttcttgacgatggcagtccagttgcagtgaagaagtacatgaaccagaatatgaaagaagggtttgacaaagagataactatccattgccaagtcaaccacaagaacatagtcaagcttttgggttattgttcagaggaaaatgccttgacgatggtcactgagtacattcccagaggaaacctcaaagacctccttcatggaagtgatgatcccatttcttttgaggcaagattgcgtattgctatagattgtgcagatgcattagccttcatgcattcaaaggatccgccaatcattcacggtgacatcaaacctgacaatatactcttggatgataacttgggtgcaaaattatctgactttggaatatcaaggttgctttctatggagaatagttattttactaataatgtaataggaagcagaggttacatggatccagaacacattcagactggccgggttgatcctaagaatgatgtttacagttttggggttgttttggtagaactagttaccagagctatggcagctcagaatgggacatgtaacgaccttgcaaagaaattcattgaagctttcctccaaaaaaatatttttttgaaagtttttggaaagcaaaaaaaggcaagaagagagatgtttgatacccagatagcaaatgcgagcaacatggaggttctagaaaaaattggagagctggcaattgagtgtctcagaagggatatcaagaaacgtcctgaaatgaatcatgttgtagaacgtcttcgaatgcttggtaaagatcacgaaaaaagacaagatagaaagccagaaaaggtaagcctatgacgtctaaggtttttcaagctatagctcgagcacttctacccttggttggggtgtgaccatgtgatgctgctttagagaaagttgcgcatattttcatttaaaaaaaatacatgggtcctccgtcttcatctaaataaacatctcacaaaagccaacacctccatctaaaaaaagtaaaaaaaaaagtaaataatttaccaccgcagcctatcagcgggctccactatgcatagccctccatttaaaaaaatacatagggtcctcaccttgatctaaaaaaacatttataaaaatctcaccttcatttaaaaaatttatttcaaaagctttttcaccgcggccaaccagcttgcgccacatggcatagctggttggccgtcaccttcatttaaaaatcttattccaaaagtgttttcaccgcggccaaccagcttgcgctacgtggcatagctggttgaccgccaccttcatttaaaaagtttatttcaaaagctttttaatcacggccaaccagcttgcggcacgtggcatagctggttgaccatcaccttgatttaaaaaatatttcaaaagctttttcaccgcggccaaccagcttgcgccacatggcatagctgattgaccatccttcacgctacgcttaatgggtttaattaatgcaaaccatatagtccactaccgcatgacttggcctgagtttttcagttcaaaccatccaacagctgttcttcatgtttagttaaatgttcaatggccagtctgcaaattgcaccagatggtggcattcaatatgcatcaagttttgacgtgcaacctcttgatctcacgtgtattgtaccggggctgattaacaacttagctcttctttgctccgtaaggtattacttcctccatgccaaaatagtctcaactttgtactaaagttgtactaggcttgagacacatattttgagacggagggagtattaaataagcacatacaaaaataaaaagatattgagagtggtttttctacaccccagttcagtgcacccgcagtgcacccacacaagaaaacatagcaaaacattttgaaaaatcagaaacattgtgagaatgattatgaacaaatgctatggatgcttgcaaagtttggtggtcaaataacatccgaggagtttgtacaaaaaaacaaaattactcaaaatgtacgtgcactgtttgagcagaatttgtaattttgttttttgcagaactccttgcatgttatttgaccaccaaactttgcaagcatccataatacttgctcataattattcccacaaagtttcatttttttttcaaaatacttcgctatgttttctcacgtgggtgcaccgagctagggttcagcacccatgttgcagactggagtagtcactagtatataaaattaattataaattttatgaatctatggcaaatgacaagtttttcgggggttttcatgacctaaaaagaatatatttaatagcatgcatgatgccctaatatacttaaagttattcttctcaatcaatcagcaacatggagtggtgcctcctgatggtaatacaacctttagctcttcgtggccaaagggtagattagaaaatggaaggaaatcttcttcctctgatgccaagagtctgtaagtggaagattgccgtatttctcttgcaagtacacatttcctttttactctttgttttgtacactttatcctttttgatcctttatcttagtttttacagtcttacgaccgtgttctctaagtttctttagttataatatcatctagatctcctaggaacatacgtgtcagtaatttttgtattgttttatcaatttttatgagtactgtgagtgcatctctcatcgtttttcgtcagaacgctacagtagtactctagaacatcatgctcccctttaattgcatttttcattctaatcattattttagcctgttgagaaatttaatcatagtctttgttggttcctttatatggagcctactctgtgtatcccattcagataaacaattattttaatctaaaactaaaaaaagcaaggaccgcattatgttttttttcgcgaatacgcaaaagctttgcgtatctttgcattgatagatagagtagcaatatatgggagtcttacaagatgaaggaaaggctaactagctcgtgcacaatgatggccagcatcggtagccttgacgcacagacggcggggtgtgcagcccgatcggacctagcctacgtctccggcaggatgagggccatgcccttggcgccggcgcgcgcccatagccgcgcctcctcctggatcatgtgcactgcgcgtcccacggcaggctggtcgccgtcgaatagacacccgttccgccgcattatgtctctccctcttccgtcatttggttatagtatggacattatgagcatatgatttggtcaatgttaaagaaagaaggcgcacactgtgctggaacttggagccatataaaaatgcctttctaatttattttattatggagaattgtttctcaaaccctttgtagctccaatgtaaaaaataatttgaactcttgaattatgtctgctcatagatgcacctcatacttatatctactgatgtttttgtgtaaatttgtttacgtttttgttcagtgtcaacctggtagaatcaatatgacatctagtctttattttccggcaggttcagtcataggggggtggaagcagtagacgaagaaaatcaacatccattattgcgaagaacgtcaattggaaatggtctgtgaatacgacactggagatggctggtctattctctgattccttccataaatgttttttgttccaatacttaacaaagaactgcttaatttctgccatttgcaggtcctccaggatcatttcatgattggacctgtgggaacgacataggaggccctgacgaagtattctctggaggacactggcgtcttctcggatgccagaatggcaagaactttgttttgtcccttgctctgtttcaattgttgcaactgagctgcttatttgacgtgttaatttggatttttcatcaggcctccacatttttgaggcgctcgaggatgttgattaccttgtaagttgttgatgaatgtcagtatgaataggtagtttgaatctttttggccgcatacccttgttgcttgatccatgtgcacttcccataggtaagagccgttggcaaagcaatgaaggccgttggtgtgattgaggcaccctgcgaggctatatttcagcttctcatgagcatggacagtagccgttatgagtaattcttcttttgtttcaataaatcaaccccacaattgtgtattagtacctcttttttcaaagaattctcatttttcactgtttttctttcgttattttaggtgggactgcagcttctcgtatggtagtctagtggaggaggtagatggccacactgcaatactataccataggccacacctagattggttcttgacgtatgttttgcttctttctggaattattccttttttttcatgctgtgttctacaagaagcatcgaactcactgcaaaattaaaagccacgagacatcttctttctttcattggcaaacaaacatgccattatcttatattcatgagtcatgacaaatgttcacttattttacttgtacatttggtaggtttaaatgactacctatgctagttaacactccctccgttcactattactagatgttttggatatttcagtatggactacatacagctgaaatgagtgaataattaaacacactaaaatgtgtctatgtacattcgattcggaaaaaaaattagcacatctcataatagtgaacggaggaagtgttgattttttggtgtatatacatagaaatgttgttccggctggtgaacacaagctcataaaacctgatattatctgatattgtgcctttaagctttagaattatagagcatctttcatcatccaaccataccacattttggcgaatttcagtctttataaaattgttgtgatctagcatggttatgatgaatactttaacaggtttgtttggcctcgtgatctttgttatgtacgatattggcagcgtaacgacgacggaggttacggttggtattttcagagttctacactaatattgatgtgcacaagcaccaaacataggtacctcgaatgtagtcatttgttttcatgacttatgtttgatggttgcattctgtaattggtggtttgcagtggtgttgttccaatccagagagcacccgaaatgtggtccacagccaggatttgtgagggcatacattgagagtaagagaattgatcagatgaattcacttatgttgatgtattgtggctaccagatttccgttgcttaacatttttctcttttacatttattttagttggcgggttcaaaatttctccactgaaaacccgtaatggaagaactcgaacacaagtacaataccttatgaagatggatttgaagggttggggcgttggttacttatcctcgtttcagcagcattgcgtcctccgcatgctgaacagtattgctggtaaaactcttggttctgtaataatcttctgtacaacttttgcaagataccacaattaatgttatgtgtcctagtctctaaatactattgaggatcatgtttgttttgtttggggcagagtttagggatttagagtaacttatcggaatgactaatttttgtcttagtctattagtttggcagtgtccagacattatcttacattagatcattgtaactggttcagagttatttgagctattttactttgctcactactccctccgttctgaaataattgtctttctagatatttcaacaagtgactacatacggagcaaaatgagtgaatctacactctaaaacatgtctatatacatccgtatgttgtagtccatttgagatggctagagagacaattatttcggaacggagggagtagtaaagagtcgttgtggtttgttgacgtcaattttttttccatcccaatgagcccaatgcaagttcccttctctccgggatgatgtgatggatcaatggttcttgcggtgattttatgttaccttactaacaatattaatagtgtgtggttctttttgaggttttttttttgcggtgaaaaaggaagctttatttaattactgatgatggtaagattacatcagtagccagcaggctaaccagagcatcaggcacatcgtgcaaccacaactcagttcagtgctctgctatcgaccaataggctagtcgatctgcagccctattctgcgaacgatcaaaacataaaaggacaagctccctctctcctaacatctccttagtttcctcaataacatggcccaagtatgacttattcatctccttctcttttagtaccttcacagccgcagcacaatctgtctgaacctgaagtggtgccgtagagtgcatcattgctgcccgtactccctctctgattgccaaaagttcagcttcaaaagcatcgttgcaatgaggcacaaaccaacaggccgaaagaacatgccttccgctgctgtctctagttatcattgccgtgcccgcaccattatctttatttggaggggaggttttctccttttgccgtgttcaatccctcattcagcttgaaaacccgagttcttcaaaactaagcctatttccaccttgggtctcatcagatcatcactatagattctcaagccttctcatcctgcatcttgttgtaaactgccattcacggcacacatctgaaatgtatgctccaaattttttatgtgactcaagtttatctttatgcttgctaaacatctgcaaaaagaaaaaaaaatcttgtgtatcacatcttgtatattttctacaatatgatcaacttggattgttagttctgcaaatatttagcagaccataacaaacttttattgttggtatatctcttcgtctctagacactgtttaactactcgttattacacgcatatggatgcccaacatgagatatgatgttaagttgatctgtgtgcagtaccacttacgctctgcggcctcaccttctttttttctactgatagggctcagggaatggttttcacgaagtgatgaaattccaacttcgatggatcaaagtagatattctacaatgcttgaagaggagtcagatgaagacgagttgtcttcaggaagtggtgaaagttgataggatttctgctaaggccagtatgattccatctgtttcatcgaagtactgatcacaaagtatatattctaaaatgcttgaagaggaatctttttttcttcgcatacttgatgaggagtctggttgacaagaataactcaaaatgaaaccgtcatctaatggccggcttcaaatcagcgatagaattcctggagctaaaaagagctaaatctcctgggcaggagatttacttggtctagtgaacaacaaaatccaaccgtttgtttggttcactgctcctatttcccaccttaggtctcatcagatcatcgctgtagattttcacgccttctcattcctcatcttgttgtaaactgccattcacgtcacacatctgcaatttatgctggaaattttatatttgggaatcaagatttatcaatatccttgctaagcttttgcaaataactcttttgtatcacacaccttgcatcttttctacagtatatgatcaacttggatttacggtcctgcaaatatttagcagaccgtaacgaacttttattcttggtatatatactcccttatcgtccctagacactgcttaaccactcgtttaagtcttattacacacgcatagggatgtccaacacgaatgatattctgggaagttgatccgtgcaatagcacttacacactgcagtccggcgtccgcgccttcttttaccactgacagggttcagggaatggttttcatgaatctatagaggtcaaatcctgttgtaaactgacaggcctgtaccacaaccaactactgaatctgaatttcaagcactaggccagatctgaaattgaagctcttgtgtgtgtgtgtgtgtgttagcaaaaactaagacaaattaaaggggaagtccgatcagattagcagtactacgtttatacagtgtaccttggctaatccggtggtgagtcgacgcggttgcggacgtacgcaagggtagcaacgaaggtcacggcggca

SEQ ID NO: 9 - DNA, 1872 bp, Triticum turgidum
atggagctcccacgaaacaaacttgcagatttgaaccaaggaaatgaaaatttaaaggcaaaggcaaagtggacacccaatgccaggaggttcacagaacatcagattaaaagaattactaagaactatagaactcatgttggcaaaggtgcctttggtgaggttttccgaggttttcttgacgatggcagtccagttgcagtgaagaagtacatgaaccagaatatgaaagaagggtttgacaaagagataactatccattgccaagtcaaccacaagaacatagtcaagcttttgggttattgttcagaggaaaatgccttgacgatggtcactgagtacattcccagaggaaacctcaaagacctccttcatggaagtgatgatcccatttcttttgaggcaagattgcgtattgctatagattgtgcagatgcattagccttcatgcattcaaaggatccgccaatcattcacggtgacatcaaacctgacaatatactcttggatgataacttgggtgcaaaattatctgactttggaatatcaaggttgctttctatggagaatagttattttactaataatgtaataggaagcagaggttacatggatccagaacacattcagactggccgggttgatcctaagaatgatgtttacagttttggggttgttttggtagaactagttaccagagctatggcagctcagaatgggacatgtaacgaccttgcaaagaaattcattgaagctttcctccaaaaaaatatttttttgaaagtttttggaaagcaaaaaaaggcaagaagagagatgtttgatacccagatagcaaatgcgagcaacatggaggttctagaaaaaattggagagctggcaattgagtgtctcagaagggatatcaagaaacgtcctgaaatgaatcatgttgtagaacgtcttcgaatgcttggtaaagatcacgaaaaaagacaagatagaaagccagaaaagcaacatggagtggtgcctcctgatggtaatacaacctttagctcttcgtggccaaagggtagattagaaaatggaaggaaatcttcttcctctgatgccaagagtctgttcagtcataggggggtggaagcagtagacgaagaaaatcaacatccattattgcgaagaacgtcaattggaaatggtcctccaggatcatttcatgattggacctgtgggaacgacataggaggccctgacgaagtattctctggaggacactggcgtcttctcggatgccagaatggcctccacatttttgaggcgctcgaggatgttgattaccttgtaagagccgttggcaaagcaatgaaggccgttggtgtgattgaggcaccctgcgaggctatatttcagcttctcatgagcatggacagtagccgttatgagtgggactgcagcttctcgtatggtagtctagtggaggaggtagatggccacactgcaatactataccataggccacacctagattggttcttgacgtttgtttggcctcgtgatctttgttatgtacgatattggcagcgtaacgacgacggaggttacgtggtgttgttccaatccagagagcacccgaaatgtggtccacagccaggatttgtgagggcatacattgagattggcgggttcaaaatttctccactgaaaacccgtaatggaagaactcgaacacaagtacaataccttatgaagatggatttgaagggttggggcgttggttacttatcctcgtttcagcagcattgcgtcctccgcatgctgaacagtattgctggtaaaactcttggttctgtaataatcttctgtacaacttttgcaagataccacaattaa

SEQ ID NO: 10 - DNA, 1659 bp, Triticum turgidum
atggagctcccacgaaacaaacttgcagatttgaaccaaggaaatgaaaatttaaaggcaaaggcaaagtggacacccaatgccaggaggttcacagaacatcagattaaaagaattactaagaactatagaactcatgttggcaaaggtgcctttggtgaggttttccgaggttttcttgacgatggcagtccagttgcagtgaagaagtacatgaaccagaatatgaaagaagggtttgacaaagagataactatccattgccaagtcaaccacaagaacatagtcaagcttttgggttattgttcagaggaaaatgccttgacgatggtcactgagtacattcccagaggaaacctcaaagacctccttcatggaagtgatgatcccatttcttttgaggcaagattgcgtattgctatagattgtgcagatgcattagccttcatgcattcaaaggatccgccaatcattcacggtgacatcaaacctgacaatatactcttggatgataacttgggtgcaaaattatctgactttggaatatcaaggttgctttctatggagaatagttattttactaataatgtaataggaagcagaggttacatggatccagaacacattcagactggccgggttgatcctaagaatgatgtttacagttttggggttgttttggtagaactagttaccagagctatggcagctcagaatgggacatgtaacgaccttgcaaagaaattcattgaagctttcctccaaaaaaatatttttttgaaagtttttggaaagcaaaaaaaggcaagaagagagatgtttgatacccagatagcaaatgcgagcaacatggaggttctagaaaaaattggagagctggcaattgagtgtctcagaagggatatcaagaaacgtcctgaaatgaatcatgttgtagaacgtcttcgaatgcttggtaaagatcacgaaaaaagacaagatagaaagccagaaaagcaacatggagtggtgcctcctgatggtaatacaacctttagctcttcgtggccaaagggtagattagaaaatggaaggaaatcttcttcctctgatgccaagagtctgttcagtcataggggggtggaagcagtagacgaagaaaatcaacatccattattgcgaagaacgtcaattggaaatggtcctccaggatcatttcatgattggacctgtgggaacgacataggaggccctgacgaagtattctctggaggacactggcgtcttctcggatgccagaatggcctccacatttttgaggcgctcgaggatgttgattaccttgtaagagccgttggcaaagcaatgaaggccgttggtgtgattgaggcaccctgcgaggctatatttcagcttctcatgagcatggacagtagccgttatgagtgggactgcagcttctcgtatggtagtctagtggaggaggtagatggccacactgcaatactataccataggccacacctagattggttcttgacgtttgtttggcctcgtgatctttgttatgtacgatattggcagcgtaacgacgacggaggttacggttgtggtgttgttccaatccagagagcacccgaaatgtggtccacagccaggatttgtgagggcatacattga

SEQ ID NO: 11 - DNA, 1671 bp, Triticum turgidum
atggagctcccacgaaacaaacttgcagatttgaaccaaggaaatgaaaatttaaaggcaaaggcaaagtggacacccaatgccaggaggttcacagaacatcagattaaaagaattactaagaactatagaactcatgttggcaaaggtgcctttggtgaggttttccgaggttttcttgacgatggcagtccagttgcagtgaagaagtacatgaaccagaatatgaaagaagggtttgacaaagagataactatccattgccaagtcaaccacaagaacatagtcaagcttttgggttattgttcagaggaaaatgccttgacgatggtcactgagtacattcccagaggaaacctcaaagacctccttcatggaagtgatgatcccatttcttttgaggcaagattgcgtattgctatagattgtgcagatgcattagccttcatgcattcaaaggatccgccaatcattcacggtgacatcaaacctgacaatatactcttggatgataacttgggtgcaaaattatctgactttggaatatcaaggttgctttctatggagaatagttattttactaataatgtaataggaagcagaggttacatggatccagaacacattcagactggccgggttgatcctaagaatgatgtttacagttttggggttgttttggtagaactagttaccagagctatggcagctcagaatgggacatgtaacgaccttgcaaagaaattcattgaagctttcctccaaaaaaatatttttttgaaagtttttggaaagcaaaaaaaggcaagaagagagatgtttgatacccagatagcaaatgcgagcaacatggaggttctagaaaaaattggagagctggcaattgagtgtctcagaagggatatcaagaaacgtcctgaaatgaatcatgttgtagaacgtcttcgaatgcttggtaaagatcacgaaaaaagacaagatagaaagccagaaaagcaacatggagtggtgcctcctgatggtaatacaacctttagctcttcgtggccaaagggtagattagaaaatggaaggaaatcttcttcctctgatgccaagagtctgttcagtcataggggggtggaagcagtagacgaagaaaatcaacatccattattgcgaagaacgtcaattggaaatggtcctccaggatcatttcatgattggacctgtgggaacgacataggaggccctgacgaagtattctctggaggacactggcgtcttctcggatgccagaatggcctccacatttttgaggcgctcgaggatgttgattaccttgtaagagccgttggcaaagcaatgaaggccgttggtgtgattgaggcaccctgcgaggctatatttcagcttctcatgagcatggacagtagccgttatgagtgggactgcagcttctcgtatggtagtctagtggaggaggtagatggccacactgcaatactataccataggccacacctagattggttcttgacgtttgtttggcctcgtgatctttgttatgtacgatattggcagcgtaacgacgacggaggttacggttggtattttcagagttctacactaatattgatgtgcacaagcaccaaacataggtacctcgaatgtagtcatttgttttcatga

SEQ ID NO: 12 - DNA, 1482 bp, Triticum turgidum
atggagctcccacgaaacaaacttgcagatttgaaccaaggaaatgaaaatttaaaggcaaaggcaaagtggacacccaatgccaggaggttcacagaacatcagattaaaagaattactaagaactatagaactcatgttggcaaaggtgcctttggtgaggttttccgaggttttcttgacgatggcagtccagttgcagtgaagaagtacatgaaccagaatatgaaagaagggtttgacaaagagataactatccattgccaagtcaaccacaagaacatagtcaagcttttgggttattgttcagaggaaaatgccttgacgatggtcactgagtacattcccagaggaaacctcaaagacctccttcatggaagtgatgatcccatttcttttgaggcaagattgcgtattgctatagattgtgcagatgcattagccttcatgcattcaaaggatccgccaatcattcacggtgacatcaaacctgacaatatactcttggatgataacttgggtgcaaaattatctgactttggaatatcaaggttgctttctatggagaatagttattttactaataatgtaataggaagcagaggttacatggatccagaacacattcagactggccgggttgatcctaagaatgatgtttacagttttggggttgttttggtagaactagttaccagagctatggcagctcagaatgggacatgtaacgaccttgcaaagaaattcattgaagctttcctccaaaaaaatatttttttgaaagtttttggaaagcaaaaaaaggcaagaagagagatgtttgatacccagatagcaaatgcgagcaacatggaggttctagaaaaaattggagagctggcaattgagtgtctcagaagggatatcaagaaacgtcctgaaatgaatcatgttgtagaacgtcttcgaatgcttggtaaagatcacgaaaaaagacaagatagaaagccagaaaagcaacatggagtggtgcctcctgatggtaatacaacctttagctcttcgtggccaaagggtagattagaaaatggaaggaaatcttcttcctctgatgccaagagtctgttcagtcataggggggtggaagcagtagacgaagaaaatcaacatccattattgcgaagaacgtcaattggaaatggtcctccaggatcatttcatgattggacctgtgggaacgacataggaggccctgacgaagtattctctggaggacactggcgtcttctcggatgccagaatggcctccacatttttgaggcgctcgaggatgttgattaccttgtaagagccgttggcaaagcaatgaaggccgttggtgtgattgaggcaccctgcgaggctatatttcagcttctcatgagcatggacagtagccgttatgagtgggactgcagcttctcgtatggtagtctagtggaggaggtttgtttggcctcgtga

SEQ ID NO: 13 - DNA, 1008 bp, Triticum turgidum
atggagctcccacgaaacaaacttgcagatttgaaccaaggaaatgaaaatttaaaggcaaaggcaaagtggacacccaatgccaggaggttcacagaacatcagattaaaagaattactaagaactatagaactcatgttggcaaaggtgcctttggtgaggttttccgaggttttcttgacgatggcagtccagttgcagtgaagaagtacatgaaccagaatatgaaagaagggtttgacaaagagataactatccattgccaagtcaaccacaagaacatagtcaagcttttgggttattgttcagaggaaaatgccttgacgatggtcactgagtacattcccagaggaaacctcaaagacctccttcatggaagtgatgatcccatttcttttgaggcaagattgcgtattgctatagattgtgcagatgcattagccttcatgcattcaaaggatccgccaatcattcacggtgacatcaaacctgacaatatactcttggatgataacttgggtgcaaaattatctgactttggaatatcaaggttgctttctatggagaatagttattttactaataatgtaataggaagcagaggttacatggatccagaacacattcagactggccgggttgatcctaagaatgatgtttacagttttggggttgttttggtagaactagttaccagagctatggcagctcagaatgggacatgtaacgaccttgcaaagaaattcattgaagctttcctccaaaaaaatatttttttgaaagtttttggaaagcaaaaaaaggcaagaagagagatgtttgatacccagatagcaaatgcgagcaacatggaggttctagaaaaaattggagagctggcaattgagtgtctcagaagggatatcaagaaacgtcctgaaatgaatcatgttgtagaacgtcttcgaatgcttggtaaagatcacgaaaaaagacaagatagaaagccagaaaaggttcagtcatag

SEQ ID NO: 14 - protein, 645 aa, Triticum turgidum
MELPRNKLADLNQGNENLKAKAKWTPNARRFTEHQIKRITKNYRTHVGKGAFGEVFRGFLDDGSPVAVKKYMNQNMKEGFDKEITIHCQVNHKNIVKLLGYCSEENALTMVTEYIPRGNLKDLLHGSDDPISFEARLRIAIDCADALAFMHSKDPPIIHGDIKPDNILLDDNLGAKLSDFGISRLLSMENSYFTNNVIGSRGYMDPEHIQTGRVDPKNDVYSFGVVLVELVTRAMAAQNGTCNDLAKKFIEAFLQKNIFLKVFGKQKKARREMFDTQIANASNMEVLEKIGELAIECLRRDIKKRPEMNHVVERLRMLGKDHEKRQDRKPEKQHGVVPPDGNTTFSSSWPKGRLENGRKSSSSDAKSLFSHRGVEAVDEENQHPLLRRTSIGNGPPGSFHDWTCGNDIGGPDEVFSGGHWRLLGCQNGLHIFEALEDVDYLVRAVGKAMKAVGVIEAPCEAIFQLLMSMDSSRYEWDCSFSYGSLVEEVDGHTAILYHRPHLDWFLTFVWPRDLCYVRYWQRNDDGGYVVLFQSREHPKCGPQPGFVRAYIEIGGFKISPLKTRNGRTRTQVQYLMKMDLKGWGVGYLSSFQQHCVLRMLNSIAGLREWFSRSDEIPTSMDQSRYSTMLEEESDEDELSSGSGES

SEQ ID NO: 15 - protein, 623 aa, Triticum turgidum
MELPRNKLADLNQGNENLKAKAKWTPNARRFTEHQIKRITKNYRTHVGKGAFGEVFRGFLDDGSPVAVKKYMNQNMKEGFDKEITIHCQVNHKNIVKLLGYCSEENALTMVTEYIPRGNLKDLLHGSDDPISFEARLRIAIDCADALAFMHSKDPPIIHGDIKPDNILLDDNLGAKLSDFGISRLLSMENSYFTNNVIGSRGYMDPEHIQTGRVDPKNDVYSFGVVLVELVTRAMAAQNGTCNDLAKKFIEAFLQKNIFLKVFGKQKKARREMFDTQIANASNMEVLEKIGELAIECLRRDIKKRPEMNHVVERLRMLGKDHEKRQDRKPEKQHGVVPPDGNTTFSSSWPKGRLENGRKSSSSDAKSLFSHRGVEAVDEENQHPLLRRTSIGNGPPGSFHDWTCGNDIGGPDEVFSGGHWRLLGCQNGLHIFEALEDVDYLVRAVGKAMKAVGVIEAPCEAIFQLLMSMDSSRYEWDCSFSYGSLVEEVDGHTAILYHRPHLDWFLTFVWPRDLCYVRYWQRNDDGGYVVLFQSREHPKCGPQPGFVRAYIEIGGFKISPLKTRNGRTRTQVQYLMKMDLKGWGVGYLSSFQQHCVLRMLNSIAGKTLGSVIIFCTTFARYHN

SEQ ID NO: 16 - protein, 552 aa, Triticum turgidum
MELPRNKLADLNQGNENLKAKAKWTPNARRFTEHQIKRITKNYRTHVGKGAFGEVFRGFLDDGSPVAVKKYMNQNMKEGFDKEITIHCQVNHKNIVKLLGYCSEENALTMVTEYIPRGNLKDLLHGSDDPISFEARLRIAIDCADALAFMHSKDPPIIHGDIKPDNILLDDNLGAKLSDFGISRLLSMENSYFTNNVIGSRGYMDPEHIQTGRVDPKNDVYSFGVVLVELVTRAMAAQNGTCNDLAKKFIEAFLQKNIFLKVFGKQKKARREMFDTQIANASNMEVLEKIGELAIECLRRDIKKRPEMNHVVERLRMLGKDHEKRQDRKPEKQHGVVPPDGNTTFSSSWPKGRLENGRKSSSSDAKSLFSHRGVEAVDEENQHPLLRRTSIGNGPPGSFHDWTCGNDIGGPDEVFSGGHWRLLGCQNGLHIFEALEDVDYLVRAVGKAMKAVGVIEAPCEAIFQLLMSMDSSRYEWDCSFSYGSLVEEVDGHTAILYHRPHLDWFLTFVWPRDLCYVRYWQRNDDGGYGCGVVPIQRAPEMWSTARICEGIH

SEQ ID NO: 17 - protein, 556 aa, Triticum turgidum
MELPRNKLADLNQGNENLKAKAKWTPNARRFTEHQIKRITKNYRTHVGKGAFGEVFRGFLDDGSPVAVKKYMNQNMKEGFDKEITIHCQVNHKNIVKLLGYCSEENALTMVTEYIPRGNLKDLLHGSDDPISFEARLRIAIDCADALAFMHSKDPPIIHGDIKPDNILLDDNLGAKLSDFGISRLLSMENSYFTNNVIGSRGYMDPEHIQTGRVDPKNDVYSFGVVLVELVTRAMAAQNGTCNDLAKKFIEAFLQKNIFLKVFGKQKKARREMFDTQIANASNMEVLEKIGELAIECLRRDIKKRPEMNHVVERLRMLGKDHEKRQDRKPEKQHGVVPPDGNTTFSSSWPKGRLENGRKSSSSDAKSLFSHRGVEAVDEENQHPLLRRTSIGNGPPGSFHDWTCGNDIGGPDEVFSGGHWRLLGCQNGLHIFEALEDVDYLVRAVGKAMKAVGVIEAPCEAIFQLLMSMDSSRYEWDCSFSYGSLVEEVDGHTAILYHRPHLDWFLTFVWPRDLCYVRYWQRNDDGGYGWYFQSSTLILMCTSTKHRYLECSHLFS

SEQ ID NO: 18 - protein, 493 aa, Triticum turgidum
MELPRNKLADLNQGNENLKAKAKWTPNARRFTEHQIKRITKNYRTHVGKGAFGEVFRGFLDDGSPVAVKKYMNQNMKEGFDKEITIHCQVNHKNIVKLLGYCSEENALTMVTEYIPRGNLKDLLHGSDDPISFEARLRIAIDCADALAFMHSKDPPIIHGDIKPDNILLDDNLGAKLSDFGISRLLSMENSYFTNNVIGSRGYMDPEHIQTGRVDPKNDVYSFGVVLVELVTRAMAAQNGTCNDLAKKFIEAFLQKNIFLKVFGKQKKARREMFDTQIANASNMEVLEKIGELAIECLRRDIKKRPEMNHVVERLRMLGKDHEKRQDRKPEKQHGVVPPDGNTTFSSSWPKGRLENGRKSSSSDAKSLFSHRGVEAVDEENQHPLLRRTSIGNGPPGSFHDWTCGNDIGGPDEVFSGGHWRLLGCQNGLHIFEALEDVDYLVRAVGKAMKAVGVIEAPCEAIFQLLMSMDSSRYEWDCSFSYGSLVEEVCLAS

SEQ ID NO: 19 - DNA, 41 bp, Artificial
  Synthetic
ctgctcactttttgcctgtgaaaagttgttgctctgctttt

SEQ ID NO: 20 - DNA, 42 bp, artificial
  synthetic
ggttttcactgaatcaatagggatgaacccagccagtctgat

SEQ ID NO: 21 - DNA, 40 bp, artificial
  synthetic
caatcccaagctgactgaaaacaccgctggtattgtagcc

SEQ ID NO: 22 - DNA, 21 bp, artificial
  synthetic
acgaaggttctgttttcacca

SEQ ID NO: 23 - DNA, 21 bp, artificial
  synthetic
acgaaggttctgttttcaccg

SEQ ID NO: 24 - DNA, 23 bp, artificial
  synthetic
tcttcttgctcaaaggtaagagt

SEQ ID NO: 25 - DNA, 18 bp, artificial
  synthetic
atgtgcggcaggagaaga

SEQ ID NO: 26 - DNA, 18 bp, artificial
  synthetic
atgtgcggcaggagaagg

SEQ ID NO: 27 - DNA, 21 bp, artificial
  synthetic
atactcttcacggtcgtcttc

SEQ ID NO: 28 - DNA, 41 bp, artificial
  synthetic
gttaccctccacagcaaggtgcgcattacttccacttcttg

SEQ ID NO: 29 - DNA, 42 bp, artificial
  synthetic
gatgctctgcacatgtgttatggcagctccagcttattcgtc

SEQ ID NO: 30 - DNA, 51 bp, artificial
  synthetic
ggtctcttgcaacatacagtaacaagagtggtagtctagtagaggttggtg

SEQ ID NO: 31 - DNA, 47 bp, artificial
  synthetic
ctgtattctaatgcagattagctgttcacgcataattttgtccacac

SEQ ID NO: 32 - DNA, 42 bp, artificial
  synthetic
gagacgaacgaaaccgagatgatagtgtcaattggtggaagg

SEQ ID NO: 33 - DNA, 47 bp, artificial
  synthetic
caccagtagatcctcaacaatacacttgagaatggaatgcaacgtag

SEQ ID NO: 34 - DNA, 42 bp, artificial
  synthetic
tcttacttgttcacaaaactgagggcgcatgaggagcttgac

SEQ ID NO: 35 - DNA, 25 bp, artificial
  synthetic
tggtaatcaagtttcacattgttca

SEQ ID NO: 36 - DNA, 21 bp, artificial
  synthetic
ggaaggacacctttcggtatt

SEQ ID NO: 37 - DNA, 20 bp, artificial
  synthetic
cagatgaccaaccaaaagca

SEQ ID NO: 38 - DNA, 20 bp, artificial
  synthetic
gtcatattggtgcccagtga

SEQ ID NO: 39 - DNA, 20 bp, artificial
  synthetic
gactttcttccctcgggact

SEQ ID NO: 40 - DNA, 20 bp, artificial
  synthetic
ctcgcacgcctataaaagga

SEQ ID NO: 41 - DNA, 18 bp, artificial
  synthetic
caaccgtgcctccaaaca

SEQ ID NO: 42 - DNA, 18 bp, artificial
  synthetic
cgggtgttgtccgttgag

SEQ ID NO: 43 - DNA, 20 bp, artificial
  synthetic
tctgtgatgcctgtgatggt

SEQ ID NO: 44 - DNA, 20 bp, artificial
  synthetic
aaagtttgggatttggcaat

SEQ ID NO: 45 - DNA, 18 bp, artificial
  synthetic
ggtgacggcgagtgtacg

SEQ ID NO: 46 - DNA, 18 bp, artificial
  synthetic
gacgcaattgtccgctgt

SEQ ID NO: 47 - DNA, 20 bp, artificial
  synthetic
caatgctcgtagctgttcca

SEQ ID NO: 48 - DNA, 18 bp, artificial
  synthetic
gagcattgttgggggttg

SEQ ID NO: 49 - DNA, 20 bp, artificial
  synthetic
tgttgctatgccatcaccat

SEQ ID NO: 50 - DNA, 20 bp, artificial
  synthetic
ctataccgctggtgggagaa

SEQ ID NO: 51 - DNA, 18 bp, artificial
  synthetic
aagctccgctgcaatgac

SEQ ID NO: 52 - DNA, 20 bp, artificial
  synthetic
acctgacatcctcgaaccac

SEQ ID NO: 53 - DNA, 20 bp, artificial
  synthetic
taatgtttggacgaggcaca

SEQ ID NO: 54 - DNA, 26 bp, artificial
  synthetic
tttttacttgttgcttgttacaattt

SEQ ID NO: 55 - DNA, 20 bp, artificial
  synthetic
ccgtgtcagccacctacaat

SEQ ID NO: 56 - DNA, 20 bp, artificial
  synthetic
gcactctaccaccgaacaca

SEQ ID NO: 57 - DNA, 20 bp, artificial
  synthetic
gtagtggctcgttcggtgat

SEQ ID NO: 58 - DNA, 20 bp, artificial
  synthetic
tttcgcatcccaccctactg

SEQ ID NO: 59 - DNA, 20 bp, artificial
  synthetic
catccattcctccgacaagt

SEQ ID NO: 60 - DNA, 20 bp, artificial
  synthetic
cactgcaatgcaaaaatgct

SEQ ID NO: 61 - DNA, 31 bp, artificial
  synthetic
caccctcgagcgaggtggtcgtccagtagtt

SEQ ID NO: 62 - DNA, 24 bp, artificial
  synthetic
ctaaggagactacagacctaacat

SEQ ID NO: 63 - DNA, 26 bp, artificial
  synthetic
cacccagtagggtgggatgcgaaata

SEQ ID NO: 64 - DNA, 33 bp, artificial
  synthetic
ctttacctaggttctctctccatcccaaccaat

SEQ ID NO: 65 - DNA, 22 bp, artificial
  synthetic
ggcctccagaagaagatgttgg

SEQ ID NO: 66 - DNA, 22 bp, artificial
  synthetic
gagcctgacctattgcatctcc

SEQ ID NO: 67 - DNA, 20 bp, artificial
  synthetic
tgggtcgaaggaaacaaata

SEQ ID NO: 68 - DNA, 21 bp, artificial
  synthetic
aacagcactgcgatggtaata

SEQ ID NO: 69 - DNA, 22 bp, artificial
  syntheetic
ggagatagagcacattacagac

SEQ ID NO: 70 - DNA, 20 bp, artificial
  synthetic
tttcgcatcccaccctactg

SEQ ID NO: 71 - DNA, 20 bp, artificial
  synthetic
ttgacaacgtgaaggcgaag

SEQ ID NO: 72 - DNA, 20 bp, artificial
  synthetic
ggcaaagatgagacgctgct

SEQ ID NO: 73 - DNA, 24 bp, artificial
  synthetic
gaaattgatttgaagattgaagca

SEQ ID NO: 74 - DNA, 23 bp, artificial
  synthetic
catatttgtttccttcgacccaa

SEQ ID NO: 75 - DNA, 20 bp, artificial
  synthetic
gtggcaatgcagatggtcct

SEQ ID NO: 76 - DNA, 24 bp, artificial
  synthetic
ttgagaagacttgatggcgatgtc

SEQ ID NO: 77 - DNA, 21 bp, artificial
  synthetic
tccgacaatggttgaggtagc

SEQ ID NO: 78 - DNA, 22 bp, artificial
  synthetic
gcaacaattgcctttcctgttc

SEQ ID NO: 79 - DNA, 21 bp, artificial
  synthetic
ctgctgctacctgttctgtaa

SEQ ID NO: 80 - DNA, 20 bp, artificial
  synthetic
acagacagtgacacggacat

SEQ ID NO: 81 - DNA, 55 bp, artificial
  synthetic
aagcagtggtaacaacgcagagtactttttttttttttttttttttttttttttt

SEQ ID NO: 82 - DNA, 25 bp, artificial
  synthetic
aagcagtggtaacaacgcagagtac

SEQ ID NO: 83 - DNA, 18 bp, artificial
  synthetic
caggcaggctgctgctac

SEQ ID NO: 84 - DNA, 21 bp, artificial
  synthetic
gtcttcatatgctgcttgcac

SEQ ID NO: 85 - RNA, 24 nt, artificial
  synthetic
gcugauggcgaugaaugaacacug

SEQ ID NO: 86 - DNA, 24 bp, artificial
  synthetic
gctgatggcgatgaatgaacactg

SEQ ID NO: 87 - DNA, 21 bp, artificial
  synthetic
tgcttccgctgactcgatggc

SEQ ID NO: 88 - DNA, 20 bp, artificial
  synthetic
tgcagcagcctaacaatctg

SEQ ID NO: 89 - DNA, 48 bp, artificial
  synthetic
ggggacaactttgtatagaaaagttgagattagccttttcaatttcag

SEQ ID NO: 90 - DNA, 48 bp, artificial
  synthetic
ggggactgcttttttgtacaaacttgcgtgttctctccaaatgaaatg

SEQ ID NO: 91 - DNA, 48 bp, artificial
  synthetic
ggggacaagtttgtacaaaaaagcaggctccrccatggattaccaagg

SEQ ID NO: 92 - DNA, 47 bp, artificial
  syntheetic
ggggaccactttgtacaagaaagctgggtggttgatgcctgtagagc

SEQ ID NO: 93 - DNA, 50 bp, artificial
  synthetic
ggggacagctttcttgtacaaagtgggcatggtgagcaagggcgaggagc

SEQ ID NO: 94 - DNA, 47 bp, artificial
  synthetic
ggggacaactttgtataataaagttgcatctagagggcccggatctg

SEQ ID NO: 95 - DNA, 51 bp, artificial
  synthetic
ggggacaagtttgtacaaaaaagcaggctccrccatgaagaaactaacaag

SEQ ID NO: 96 - DNA, 49 bp, artificial
  synthetic
ggggaccactttgtacaagaaagctgggtgcttttgcaacaattgcctc

SEQ ID NO: 97 - DNA, 20 bp, artificial
  synthetic
gctgctgctacctgttctgt

SEQ ID NO: 98 - DNA, 21 bp, artificial
  synthetic
ccctacctaatatccgcgtgc

SEQ ID NO: 99 - DNA, 21 bp, artificial
  synthetic
tcccaatccttgtgtgctacc

SEQ ID NO: 100 - DNA, 20 bp, artificial
  synthetic
ttgcccaggattcaccacta

SEQ ID NO: 101 - DNA, 20 bp, artificial
  synthetic
gctgctggagcttttaaccg

SEQ ID NO: 102 - DNA, 20 bp, artificial
  synthetic
gcgagagaacgatttcccct

SEQ ID NO: 103 - DNA, 21 bp, artificial
  synthetic
tgcacgcggatattaggtagg

SEQ ID NO: 104 - DNA, 20 bp, artificial
  synthetic
tgatgaagaggaccaacgca

SEQ ID NO: 105 - DNA, 21 bp, artificial
  synthetic
gaccctttgttttgtcagagc

SEQ ID NO: 106 - DNA, 21 bp, artificial
  synthetic
gaccctttgttttgtcagagt

SEQ ID NO: 107 - DNA, 24 bp, artificial
  synthetic
aaagattgagtaagactagtagcc

SEQ ID NO: 108 - DNA, 21 bp, artificial
  synthetic
ctgctactggacagtgtaacg

SEQ ID NO: 109 - DNA, 21 bp, artificial
  synthetic
ctgctactggacagtgcaaca

SEQ ID NO: 110 - DNA, 23 bp, artificial
  synthetic
aagggcttgagttcctccatcag

SEQ ID NO: 111 - DNA, 2007 bp, Triticum dicoccum
atggattaccaaggaaacaatcttaatgatttctttcaaactaatgggcatttggtacttaaaagtgtggacaacaactataaactgcgatccttcactgaaaaggagataaagcacattacgaaaagatatagcactttgcttggtagtggctcgttcggtgatgtctacaaaggaagattagatgatcaacgcccagtcgcagtaaagagatacaaaaatggaaccaataaagaggagttcgccaaggaggtgatagtgcactcccagataaaccacaagaatgttgtcaaattgttaggatgctgcacagaggaaaatgctcttatgattgttatggagtttatctgtaatggaaacctctacaacatccttcactgtggcaatgctgatggtcctatcccttttcatttgcacaaacgtttggacatcgccattgagtcagctgaagcgctatcatgtatgcattcaatgtacagtcctgtccttcatggtgacattaaacctgccaatatactgttggatggaaagtacttgccaaagctatctgattttggaatagcaagattgctttctactgacgaggcccagcgtaccaaaactgttattggttgcataggttatgtggaccctttgttttgtcagagtgggattctcactacaaagagtgatgtatacagttttggagttgttctgttggaaatgatcacccgaaagaaagcgacggacggggctactagtcttactcaatgtttctctgaggccctgcgtagagggaagaaggtgagacaactgtttgatgtggaaattgccaatgacaagaacattaagttgatcgaagatattgcaaagctagcagctacatgcttgagactggatgataaaatgcgtccgacaattgttgaggtagcagatagacttaggaggattagaaaagctctcccgcagcgcaagagtgaaagctctacaggcatcaacaatgggctcataagaagaggaaaggcagaggatgtaccaactatttcccttgatgaaatgaagaaaataacaagaaacttcagtaatggtgctttaataggagagagctcacaaggcagagttttcttcaaagtgttaaaatatggaccggaatatgcattcaagtcttctcaagaaattgatttgaagattgaagcgatttcaagactgaaacacgagaacgttgtccaacttctcgggtattgggtcgaaggagacaaatatgttcttgcttacgagtatgcatcggggggcactttgcatgatattcttcacagcgaggaaatccaggccgtcggcaaatcggtgccaagtcaggaacagttctatcatggatgcagagagtgaagattgccttaagtgcagcagaagggcttgagttcctccatcataaggcagagcctcaggtcacccacggtaacatcatgtccagcaagatacttctctttgacaacgatatcgcaaaggttggcgacgtcggcatatccaatgtgctggtcagtgatgacatggatagctgtcatagttttagatgggaccttgacacggatcgtatgaatgatcattattatcaccaagatgattaccatgtcgatgtatatgctgctactggacagtgcaacacaaagagtgatgtatacgccttcggggttgtgctgctgaaacttttaaccggtcgtaaggcagttgatcatacactaccccgcggcaggcagagcctcgtgacatgggtatgcacccttggcaagaagaacctatgcaaccattgtgacgagcatacaattttatggaagacaatgtgttaccaaaaacaagttttagtgaagataaggtgcagcgatgcatggatccaaggcttgaaggagattaccctcgcaatgctgctaccaagatgggtgcgatcgcggcgctatgtgtgaattacaatccagatctccgaccaaacatgagcactgtcgtcaagggtctgagacaattgctacacagcga

SEQ ID NO: 112 - DNA, 2007 bp, Triticum aestivum
atggattaccaaggaaacaatcttaatgatttctttcaaactaatgggcatttggtacttaaaagtgtggacaacaactataaactgcgatccttcaccgaaaaggagataaagcacattacgaaaagatatagcactttgcttggtagtggctcgttcggtgatgtctacaaaggaagattagatgatcaacgcccagtcgcagtaaagagatacaaaaatggaaccaataaagaggagttcgccaaggaggtgatagtgcactcccagataaaccacaagaatgttgtcaaattgttaggatgctgcatagaggaaaatgctattatgattgttatggagtttatctgtaatggaaacctctacaacatccttcactgtggcaatgctgatggtcctatcccttttcatttgcacaaacgtttggacatcgccattgagtcagctgaagcgctatcatgtatgcattcaatgtacagtcctgtccttcatggtgacattaaacctgccaatatactgttggatggaaagtacttgccaaagctatctgattttggaatagcaagattgctttctactgacgaggcccagcgtaccaaaactgttattggttgcataggttatgtggaccctttgttttgtcagagtgggattctcactacaaagagtgatgtatacagttttggagttgttctgttggaaatgatcacccgaaagaaagcgacggacggggctactagtcttactcaatgtttctctgaggccctgggtagagggaagaaggtgagacaactgtttgatgtggaaattgccaatgacaagaacattaagttgatcgaagatattgcaaagctagcagctacatgcttgagactggatgataaaatgcgtccgacaattgttgaggtagcagatagacttaggaggattagaaaagctctcccccagcgcaagagtgaaagctctacaggcatcaacaatgggctcataagaagaggaaaggcagaggatgtaccaactatttcccttgatgaaatgaagaaaataacaagaaactttagtaatggtgctttaataggagagagctcacaaggcagagttttcttcaaagtgttaaaatatggaccggaatatgcattcaagtcttctcaagaaattgatttgaagattgaagcgatttcaagactgaaacacgagaacgttgtccaacttctcgggtattgggtcgaaggagacaaatatgttcttgcttacgagtatgcatcggggggcactttgcatgatattcttcacagcgaggaaatccaggccgtcggcaaatcggtgccaagtcaggaacaattctatcatggatgcagagagtgaagattgccttaagtgcagcagaagggcttgagttcctccatcataaggcagagcctcaggtcacccacggtaacatcatgtccagcaagatacttctctttgacaacgatatcgcaaaggttggcgacgtcggcatatccaatgtgctggtcagtgatgacatggatagctgtcatagttttagatgggaccttgacacggatcgtatgaatgatcattgttatcaccaagatgattaccatgtcgatgtatatgctgctactggacagtgcaacacaaagagtgatgtatacgccttcggggttgtgctgctgaaacttttaaccggtcgtaaggcagttgatcatacactaccccgcggcaggcagagcctcgtgacatgggtatgcacccttggcaagaagaacctatgcaaccattgtgacgagcatacaattttatgttagacaatgtgttaacaaaaacaagttttagtgaagataaggtgcagcgatgcatggatccgaggcttgaaggagattaccctcgcaatgctgctaccaagatgggtgcgatcgcggcgctatgtgtgaattacaatccagatctccgaccaaacatgagcactgtcgtcaagggtctgagacaattgctacacagcga

SEQ ID NO: 113 - DNA, 1811 bp, Triticum durum
ccagtcgcagataagagatacaaaaatggaaccaataaagaggaattcgccaaggaggtgatagtgcattcccagataaacaacaagaatgttgtcagattgttaggctgctgcaccgaggaaaatgccctaatgattgttatggagtttatctgtaatggaaacctctatagcatccttcactgtggcaatgttgatggtcctatccccttccctttgtacaaacgtttggacatcgccattgagttagctgaagcactatcatgtatgcattcgatgtacagtcctgtccttcatggtgacattaaacctgccaatatactgttggatgaaaagtacttgccaaagctatctgattttggaatagcaagattcctttctacttacgaggcccagcgtaccgaaactgttattggttgcataggttatgtggaccctttgttttgtcagagtggggttctgactacaaagagtgatgtatacagttttggagttgttctgttggaaatgatcacccgaaagaaagcgacggagggggctactagtcttactcaatgtttcgtcgaagccctgggaagagggaagaaggtgagacaactgtttgatgtggaaattgccaatgacaggaagaagatgaaattgatcgaagatattgcgaaactagcagctacatgcttgagactggatgataaaatgcgcccgacaatggttgaggtagcaggcagacttaggatgattagaaaagctctcccccagcacaagggtgaaagctctacagacatcaacaattggctcataagaagaggaaaggcagaggttgtaccaactatttcccttgatgaaatgaagaaaataacaaggaacttcagtaatggtgctctaataggagagagctcacaaggctgagttttcttcaaagtgttaaaatatggtctggaaactgcattaggatcatggcggtgtgtatcgtatgatgattgaaacaatttcaagactgaaacatgagaacgtgtccaatttctcggacattgggtcgaaggagacgaatatgttctggcatatgagtatatatcaggtggcaccttgcatgatatccttcacagcaagggtaaaatgggtattaatggtgccaaatcacgagcagctctatcatggatgcagagagtgaagattgccttaagtgcagctgaagggcttgagttcctccatcataaggcagagcgtcaggtcacccacggtaacatcatgtccagcaagatacttctctttgacaacgacatcgcaaagattggcgacgttggtatctccaatgtactggtcagtgatgacatgcgtagctgccatagttttagacgggactgtgacatgaatcgtatggatggtcgtggttttcgcccagatcattaccatgtcgatctatatgctgctactggacagtgcaacacaaagagcgatgtatacttcttcggggttgtgctgctggagcttttaagcggtcgcaaggcagttgatcatacactaccccagggcaggcagagcctcgtgacatgggtatgcacccttggcgagaagggcctatgcacccattgtgacgagcatacaattttatggaagacaatgtgttaacaaaaacaagttttagtgaagataaggtgcagcgatgcatggatccaaggcttgaaggagattaccctcgcaatgctgctaccaagatgggtgcgatcgcagcgctatgtgtgcattacaatccagatctccgaccaaacatgagcactgtcgtcaagggtctgagacaattgctgcaaatgtga

SEQ ID NO: 114 - DNA, 2005 bp, Triticum aestivum
atggattaccaaggaaacaatcttagtgatttctttcaagctaatgggcatttggtacttaaaagagtggacaacaactataaactgcggtccttcactgaaaaggagatagagcacattacagacagatatagcacttcgcttggtagtggctcgttcggtgatgtctacaaaggaagattagacgatcaacgtccagtcgcagtaaagaggtacaaaaatggaaccaagaaagaggagttcgccaaggaggtgatagtgcattcccagataaaccacaagaatgttgtcagattgttaggctgctgcacggaggaaaatgcccttatgattgttatggagtttgtctgtaatggaaacctctacaacatccttcactgtagcaatgctgatggtcctatactcttccctttggacaaacgtttggacatcgctattgaatcagctgaagcactatcatgcatgcattcaatgtacagtcctgtccttcatggtgatattaaacctgccaatatactgttagatgaaaagtacttgccaaagctatctgatttcggaatagcaaggctgctttctactgatgaggcccagcgtaccaaaactgttattggttgcataggttatgtagaccctttgttttgtcagagtgggattctaactacaaagagtgatgtatacagttttggagttgttctattggaaatgattacccgaaagaaagcgacggacgggactactagtcttactcaatgtttcgccgaggcagtgggaagtgggaagaaggtgagacaactgtttgatgtggaaattacctatgacaagaagaagatgaaattgatcgaagaaattgtgaagctagcagttacatgcttgagactggatgataaaatgcgtccgacaatggttgaggtagcagatagacttaggaggattagaaaagctctcccgaagcacaagggtgaaagatctacagacatcaataattggcacataagaagaggaaatgcacaggatgtaccaactatttcccttgatgaaatgaagaaaataacaaggaacttcagtaatggtgctctaataggagagagttcgcaaggcagagttttcttcaaagtgttaaaatatggaccggaatctgcattcaagtcttctcaagaaattgatttgaagattgaagcaatttcgagactgaaacacgagaacgttgtccaacttctcggatgttgggtcgaaggagacgaatatgttcttgcatatgagtatacattgggtggcaccttgcatgatatccttcacagcaagggtaaaaagggtgtcaggggagccaagtcaagggcagctctatcatggatgcagcgagtgaagattgccttaagtgcagcagaagggctggagttcctccatcacaaggcagagcctcaggtcacccatggtaacatcatatccagcaagatacttctctttgacaacgacatcgcaaaggttggcgacgctggtatctccaatgtgttggtcagtgacaacatgagtagatgtcatagttttagatgtggccttgacctggatcgtatggatggtcatggttatcacgaggatgattaccatgtcgatttatattctgctactggacagtgcaacacaaagagtgatgtatatgccttcggggttgtgctgctggaacttttaaccggtcgtaaggcagttgatcatacactaccccgcggcaggcagagcctcgtgacatgggtatgcacccttggcgagaagggcctatgcacccattgtgacaatacatcaattctatggaagataatgtgttgacagaaacaagtcttagtgaagataaggtgcagcgatgcgtggatccaaggcttgaaggagattaccctcacaatgctgttaccaagatgggtgcgatcgcagcgctatgtgtgcattataatccagatctccgaccaaacatgagcactgtcgtcaagggtctgagacaattgctgcacagcga

SEQ ID NO: 115 - DNA, 2012 bp, Triticum aestivum
atggattaccaaggaaacaatcttagtgatttctttcaagctaatgggcatttggtacttaaaagagtggacaacaactataaactgcggtccttcacagaaaaggagatagagcacattacagacagatatagcacttcgcttggtagtggctcgttcggtgatgtctacaaaggaagattagacgatcaacgtccagtcgcagtaaagaggtacaaaaatggaaccaagaaagaggagttcgccaaggaggtgatagtgcattcccagataaaccacaagaatgttgtcagattgttaggctgctgcacggaggaaaatgcccttatgattgttatggagtttgtctgtaatggaaacctctacaacatccttcactgtagcaatgctgatggtcctatactcttccctttggacaaacgtttggacatcgctattgaatcagctgaagcactatcatgcatgcattcaatgtacagtcctgtccttcatggtgatattaaacctgccaatatactgttagatgaaaagtacttgccaaagctatctgatttcggaatagcaaggctgctttctactgatgaggcccagcgtaccaaaactgttactggttgcataggttatgtagaccctttgttttgtcagagtgggattctaactacaaagagtgatgtatacagttttggagttgttctattggaaatgattacccgaaagaaagcgacggacgggactactagtcttactcaatgtttcgccgaggcagtgggaagtgggaagaaggtgagacaactgtttgatgtggaaattacctatgacaagaagaagatgaaattgatcgaaaaattgtgaagctagcagttacatgcttgagactggatgataaaatgcgtccgacaatggttgaggtagcagatagacttaggaggattagaaaagctctcccgaagcacaagggtgaaagctctacagacatcaataattggcacataagaagaggaaatgcacaggatgtaccaactatttcccttgatgaaatgaagaaaataacaaggaacttcagtaatggtgctctaataggagagagttcgcaaggcagagttttcttcaaagtgttaaaatatggaccggaatctgcattcaagtcttctcaagaaattgatttgaagattgaagcaatttcgagactgaaacacgagaacgttgtccaacttctcggatgttgggtcgaaggagacgaatatgttcttgcatatgagtatacattgggtggcaccttgcatgatatccttcacagcaagggtaaaaagggtgtcaggggagccaagtcaagggcagctctatcatggatgcagcgagtgaagattgccttaagtgcagcagaagggctggagttcctccatcacaaggcagagcctcaggtcacccatggtaacatcatatccagcaagatacttctctttgacaacgacatcgcaaaggttggcgacgctggtatctccaatgtgttggtcagtgacaacatgagtagatgtcatagttttagatgtggccttgacctggatcgtatggatggtcatggttatcacgaggatgattaccatgtcaatttatattctgctactggacagtgcaacacaaagagtgatgtatatgccttcggggttgtgctgctggaacttttaaccggtcgtaaggcagttgatcatacactaccccgcggcaggcagagcctcgtgacatgggtatgcacccttggcgagaagggcctatgcacccattgtgacaagtagcccgtcctatcagaattgccaacatatctaccacaatgttaaacaagataggggacattgggtgcagcgatgcgtggatccaaggcttgaaggagattaccctcacaatgctgttaccaagatgggtgcgatcgcagcgctatgtgtgcattataatccagatctccgaccaaacatgagcactgtcgtcaagggtctgagacaattgctgcacagcga

SEQ ID NO: 116 - DNA, 2012 bp, Triticum aestivum; identical to SEQ ID NO: 115

SEQ ID NO: 117 - DNA, 2012 bp, Triticum aestivum; identical to SEQ ID NO: 115

SEQ ID NO: 118 - DNA, 9116 bp, Triticum turgidum
cgaggtggtcgtccagtagttttttagttaaacggccgaaatatcaacctttttatgtaaattatattcaaacttgaatgaaaatcatccagtttgcacgaattttgtccggttggtttgagttgttgtgaaaatgtatatgaatagtgttggatgtcgaccttccgcatcggtgtccacggactaatccacatatgcacggacagatgcggaatgatttttgcaggttgcggttggatggcctcactttattttacaggcagagcatgttcgagagctggtgcttgaccacaagatggtgctcgtcgcggttgcccctcgcccccgcattcgggttcaatggagtcggcttcctccatcgctctctacgtgggaagaccccgtcctgatgtagcaacgtttccccactacacgggcgggcaagtcggtacacaagcggaagggactgtcacggcgccccccactggatagggagtgcaagagtgtcacggctgccaccgcggtcccactagacagggagcgcaagagcaccgcaggcggccaaggcgtggaagagtcaaaggacgcggagcatgaaatgatcagtgggtccgcttcgtcaaaccttggcgtgtgtgccgtgggagtcgagtgctgtctgctgtgtgtgtgggcaactgggcatcgagaatatgtggatgtaacgaacgggagcgagctaagctgttcttcctcctctggctgcctaaccccttcctcccgatctgatctctcctttctcccaaaccctagatggttgaatatcctgcgagctgaaggccgcgtccctcactgcgagcaaactgcaaacaggcgctgccgcggacttgtgctcacgctgaagaatgtctcatatctgcaatctcgcttgattgcaggctgaaaaactgcagatctcctctattaccaaggaacaggtaaccgttcctcatttgctcttgatgggattatgtatgtacccttgcaatccacattattatcactatttaggggtgctggttcctcgatgaatcgcttttttccgttgtggagtattctggcttctccaggaagcaagggatgtattcgggcttataaaactgaaatccggaaactttagccctttgccccttgttactcttgttactcttactgaaatccaaggcaacggtgcgccgcctgccggagaaggagacccgccgccctctttgcacatctcgcttgctttcctcctccagccagccgagcacgacgaggtaccaggctaggtcccagcggttgctatactcctcttagatccatggtccatccatcaaagcttcacggcgacgctggcaatataagtgttcttgcctctctcatccttggtcatgggttctttggtcggtttcttgaatcagagaaggaggtagaatgaaattgctctgttcttcccttcttctgctctcatatccaaacaccaatttaccagggaatcagaggaggtagaatgaaatagcagctgggttcccgcaaaagataaaataaaattgcagctgggctacttcagaatttttttgcgaaggcctcgcagattgagctactctctcctctatggccgagggtttcgaactttcgaagaaagagaggcaccggctaatgtggttttctccctgagggcatttctaaccgatccccaataaatagtggagtatccggtggagtaaacccttagtgaagtaaatatactccactaagttttggccggacctagctgatcccctatatttaacggagtaaaaataaataaattcatttgcatttcattttcggccacctaaacacatttctttgcttctttatttcattcaaccaacgacattttgatacattggagtacctaattcactaattcttcgctacaagagcaacaccaaagaaaacaagaaccgaaattagacattttaaaagatgtccaacttccataactgctctcactagttggattaatatcttctctatgtcttcattgttgatccgcagcttctggagcttgcacacttctttcttcttcgattctaaagaagtagacgttgcttcgcatctaatctcatctctagcctcgattgtagcagcgagtgcacgagcatcgttcaattttcgtgctatcaatagatcgatgtattgttcttcccgataccaaaacttgcaaccatcctacacataaatttgagcaaacaatgagctaccggaattgcggcgaatccggtgaaaaccgaatcaaaacaagcacataccccatcttttttgcctttgaagaacacccatccgggatgttccagcgtggtagaaactcggcgcaccacctgtcacgggcagtcatcgcacttcatgaccgacaacggtgagccgacgagccgcggggctagcgccaagacctaagcgacggtcgggcatgtctttactggcgaaccgcccatgggagagattcgcgtgggtagaggcggagccgatacctgcatgcggtgcggaggcattgccggggctgtgcggtccggttcccggccaatccatggcaaggcgcagtcgccggtggccggaagcgccaaatccggcggcggcggcggcggcagcagccgtagatccaccgattttgcgccggcgacgggacgaggaggcacaaatccaagtggtcaaggaccgtggcggagcctactaagcatcggcgttggcgggcgggggtgggaggggcggcactggcgcagatgcggcgtgggagtggagctgggaaggacgcggaggagaggggtggcttttactcagctgctgagcgatggagtaaatatagggagattcaccgcgccctgagtataatttttagaggagtaaaaccgaacttttactcctctaaacagttatagggaattggttagaaatgtcctgagtagggacgaggttgaggccttcagggctgtttcgcgcgagggatagccctggttttttcttgcttcttagtttttcttacctttgtgtgctatacctctttggtttagatttttctgtatatgctgtgtgagctgatgtgcagttttccctttacttagtgaaaaagcagagcacctgctggtttgggtcaaaaacaaaatgcagctgtatttaggcggtatattacaggatacagaaaagtaaatctacagctcttcctagatgcaaaattcaaaataatcatgttttacactttttatgtgaaaaatgaatgcttacacatacatggaagataaagccattttgtaatgccagtgatagccacttcttcagttacataggtaaattccttctcaataagtaatgatagattttaatctcaagggcactgatattaatgggcatcgtgatgcaggcaggctgctgctacctgttctgtaaatcctgtcttcatatgctgcttgcacatggattaccaaggaaacaattttaatgatttctttcaaactaatgggcattttgtacttaaaagagtggacaacaactataaactgcggtcattcactgaaaaggagatagagcacattacagacagatatagcacttcgcttggtaatggctcgttcggtgatgtctacaaaggaagattagacgatcaacgtccagtcgcagtaaagagatacaaaaatggaaccaagaaagaggagtttgccaaggaggtgatagtgcattcccagataaaccataagaacgttgtcagattgttaggctgctgcacagaggaaaatgctcttatgattgttatggagtttatctgtaatggaaacctctacaacatccttcactgtggcaatgcagatggtcctatccccttccctttggacaaacgtttggacatcgccatcgagtcagcggaagcactatcatgcatgcattcaatgtacagtcctgtccttcatggtgacattaaacctgccaatatactgttggatgaaaagtacttgccaaagctatctgattttggaatagcaagactgctttctactgatgaggcccagcgtaccaaaactgttattggttgcataggttatgtagaccctttgttttgtcagagcggtattctaactacaaagagtgatgtatacagttttggagttgttctgttggaaatgatcacccgaaaaaaagcgacggatggggctactagtcttactcaatgtttcgccgaggccctgggagggaagaaggtgagacaattgtttgatgtggaaattgccaatgacaagaagaaggtgaaattgatcgaagatattgcgaagttagcagctacatgcttgaaactggaggataaaatgcgtccgacaatggttgaggtagcagatagacttaggaggattagaaaagctctcccccagcgcaagggtgaaagctctacaggtaattaagaagagtaaaatgcattggcagtcactgctctacttcaaagtttacgtggctttttgcttagctactgatgtcagacgtggataacaacacggtatatgcagtagggtgggatgcgaaataaacaaaccttagctgcttctttttaatactttgtttatgtgtaggattacgcacaagtaatttcagtacttgtttgggtgaaaggaaaaatacacaaacttttattttcttcttttaagcacttaagtactcaaatacttcctttgtccagtgtgggagtgtcaaaaaacgtcttacgttatgggacggagggagtacatgaatatagccttcgtaggtaatttaagaaattatccttttcctgttagcatggccatttaacgaaattcttttcctttcaactatgttaggtctgtagtctccttagttgtttctgtatgtattgaatcgttttagactaaagtgcatggaatgtttaaaaatcttagtttgagtacatacgtggagttttaaggtacctcatgcattttacttttctttttaagtatattatacaattttaagtataagtagtcggacccttccccggaccctgcgctagcaggagctacatgcaatgggctgccctttttttttataagagtggactcatcaaaatgaatattatgtatatttaggttaaagacgaaccagtttgccaaaataaatgtactggttcagaagggtacatgccacccttgttttcattcccaatccttgtgtgctaccagggttcatgtccatgccaatcacataaaacacaatttactctaagcgtgtcacaaatcataagtaatgaaactttacctcactagtaaatctgtacgtgcaatgcatgttgatattaggcaaatatattaattgcacgcggatattaggtagggtattatttgcgtgtttattatgggattagcattgttatttatatttgaatgatattaactgcatgctaaacgtgttgagtgctcaccattgcggagcagcctaagtcgttggattgacctagattgatggccgagatttgttggatctgcccctttgggtctttttatattgatgatatagatagatatagattatatgagaccgttatttatttatgtcttccccaatgcaggcatcaacaatgggctcataagaacaggaaaggcagaggatctaccaactatttcccttgatgaaatgaagaaactaacaagaaacttcagtgatggtgctctaataggagagagctcacaaggcagagttttgttcgaagagttaagttatggaaagagatatgcattcaagtcttctcaagaaattgatttgaaggttatggttccgagccttaccttttcaccatttctactgacactcttcatttattagtacagaaaggtcttgccttctaactggcacatttccgtggcagattgaagcaatttcaagactgaaacacaagaacgttgtccaacttctcggaaattgggtcgaaggaaacaaatatgttcttgcttacgagtatgtatcggggggcacgttgcatgatattcttcacagagagggtgaggaactatacaattttactttttcggagtaacatgctgcatgccttttttattgaaagggggaatagtttggcaattcaacgtcagccatgtgaggaacagagcaacactcaaaagagctcgcctcctacgaaaccttaaattttcaaaaaaatagtttagtgcgtctggtatgtgaggcggggacatattttgttaacatcacttacctgctttgaatatacaatatgataaaagtaaaaatttctccaatattattctggtttatggtcacaggtgataagggtgtcagtggagccaggccaggagcagctctatcatggatgcagagagtgaagattgccttaagtgcagcagaagggcttgagttcctccatcagaaggcagagcctcaggtcacccacggtaacatcatgtccagcaagatacttctctttgacaaagataatgcaaaggttggcggcgttggtatctccaatgtactggtgcgtgataacatggttcactgtcacagttttagacaggactgtgacatggatcgtatggatggtattcgttatcacccagatgattactatgtcgatctatatgctgctactggacagtgtaacgcaaagagcgatgtatacgccttcggggttgtgctgctggagcttttaaccggtcgcgaggcagttgatcatgcactacccaaaggcaagcagagcctcgtgacatgggtatacaaccatggcgaggagaaaagcccatggagatgggtatgcatccgtgtattcattgattcgtgtgtataatgtcttgacaaggtgcattagctaaactattgatgactttgatgcacaggaaaacaatattatggaagacaatgtgttaacaaaaacaagttttagtgaagatatggtgcagcgatgcgtggatccaaggcttaaaggatattaccatcgcagtgctgttaccaaggtatgtaatttatcctgaactctaccatgtttaagtttaaccgagtaaactagtggtgaatcctgggcaatggtgcggggagatatcattttcgaaccattgtagtctattccaccaaataagcaggatttaatctccattattatactccctctgtctcataatataagacgttgatgtaataacgtcttatgttatggcacagaaggagtaagagttaattcaacattttagccccaagtttgtcagggtaccccctgttctaaattcaattcggaccatcttgtaccacaaagtttcaaatttgttcaccaccgggaagggaagaagtagtagccccacaatcctgcgttggtcctcttcatcatggctcctcccgatctcatcatggcccatcgcttcgcacggtcactgctcttcccatgtcagtcttgctatgcggcagtaagttggcacgccacctcagcctaacagcgggtctgggctgctataagagtgggaatttctcctggggtaaataccagtacaaatttgaaaactgaggataaatcttctgggaacaaagataaactcactcgtgtgaagagcatccagtgaggcaaagaaaaccggtaatctattgcacaaaaagcttcacaggaagcaacgacaatcaatccaggtaacatgttaagactatgcaggaggcaaacaagtgacatgaacacttgtgcaaacagctccaggaagcctattcatcaggaaccgctccagaaccgccatcttgattaatagcgtacagtgcattaagccttgaaggaaccgtgaccaccctcctttggcttgagattgtctttttgagtttcaccagccgtgctgctccttgtttcatatccttctgcattacagaaattagcgcgttataatcttgattgaatgactagctagggggtaaaaagatgaaactaagttttagtataatctttgagttcttgagctatgagggaccaagtgactgctctcctgattactttcttcttttggcaagcagatgggtgcgatcgcgtcgctatgcgtgaattacaatccagatctccgaccaaacatgagcactgtcgtcaagggtctgaggcaattgttgcaaaagtgagccatgtgacttggtggcatgaaactatacacattgcgggggcttatgtccgtgtcactgtctgtggccgagctgcataagatctcgaattttcatggccctattatatgccactctctgtagaacaaaatacaaatagatatgatgatcatgtatccatttgttttgcggctgatggatgcataatactatatgttatgtcacgtttggaatgagggatgtagcatatgttcgcactggatttggtgaaacatcgacagattatctgctgtccgtagctatctgtacggctaactgcttgttctgccatatcgatccagaagggactaaagtttagaatctcttcagtttgtgagaaggggaaatcgttctctcgcgcctggagtcccgtatgagatatttaattgcaatataatcatttaattaccttcagttttaggtaattaaatgattaaaagaaaagatggttgacatagatgttttttaggtaattaaatgattagattgcaattacacaaaagatgctaaggagaattaccactatctgtgtagattcagatgttaactgtctatggatgccatggaaaacaagctgggtcctgtagtttaaggttaattattcatttgttgcagggtgttgccacaaaattaaatggactttgcccctcttgcgtgtcagttgagatggcgcgtgagaatcgcctgaagcatcggatttggcatatgccatatttgttcagtaattagttatctctactatgtgttttgctggcacatctttttaaacttattgcactagtaatgcgtgcacgtgcaatgcacgtatcgtttgatctatcctaatctctcctactaaacggataaaagcatccacaattggactgtgaaaatatgacccaccccctgtatgttagttgacacatccgaacaatgtctggacgtgtccactttgaacctcatgtgtctatccatgcggccaggtccccaaattattgatcacatgcatattattggttgggatggagagagaa

SEQ ID NO: 119 - DNA, 2500 bp, Triticum turgidum
ggaacaggtaaccgttcctcatttgctcttgatgggattatgtatgtacccttgcaatccacattattatcactatttaggggtgctggttcctcgatgaatcgcttttttccgttgtggagtattctggcttctccaggaagcaagggatgtattcgggcttataaaactgaaatccggaaactttagccctttgccccttgttactcttgttactcttactgaaatccaaggcaacggtgcgccgcctgccggagaaggagacccgccgccctctttgcacatctcgcttgctttcctcctccagccagccgagcacgacgaggtaccaggctaggtcccagcggttgctatactcctcttagatccatggtccatccatcaaagcttcacggcgacgctggcaatataagtgttcttgcctctctcatccttggtcatgggttctttggtcggtttcttgaatcagagaaggaggtagaatgaaattgctctgttcttcccttcttctgctctcatatccaaacaccaatttaccagggaatcagaggaggtagaatgaaatagcagctgggttcccgcaaaagataaaataaaattgcagctgggctacttcagaatttttttgcgaaggcctcgcagattgagctactctctcctctatggccgagggtttcgaactttcgaagaaagagaggcaccggctaatgtggttttctccctgagggcatttctaaccgatccccaataaatagtggagtatccggtggagtaaacccttagtgaagtaaatatactccactaagttttggccggacctagctgatcccctatatttaacggagtaaaaataaataaattcatttgcatttcattttcggccacctaaacacatttctttgcttctttatttcattcaaccaacgacattttgatacattggagtacctaattcactaattcttcgctacaagagcaacaccaaagaaaacaagaaccgaaattagacattttaaaagatgtccaacttccataactgctctcactagttggattaatatcttctctatgtcttcattgttgatccgcagcttctggagcttgcacacttctttcttcttcgattctaaagaagtagacgttgcttcgcatctaatctcatctctagcctcgattgtagcagcgagtgcacgagcatcgttcaattttcgtgctatcaatagatcgatgtattgttcttcccgataccaaaacttgcaaccatcctacacataaatttgagcaaacaatgagctaccggaattgcggcgaatccggtgaaaaccgaatcaaaacaagcacataccccatcttttttgcctttgaagaacacccatccgggatgttccagcgtggtagaaactcggcgcaccacctgtcacgggcagtcatcgcacttcatgaccgacaacggtgagccgacgagccgcggggctagcgccaagacctaagcgacggtcgggcatgtctttactggcgaaccgcccatgggagagattcgcgtgggtagaggcggagccgatacctgcatgcggtgcggaggcattgccggggctgtgcggtccggttcccggccaatccatggcaaggcgcagtcgccggtggccggaagcgccaaatccggcggcggcggcggcggcagcagccgtagatccaccgattttgcgccggcgacgggacgaggaggcacaaatccaagtggtcaaggaccgtggcggagcctactaagcatcggcgttggcgggcgggggtgggaggggcggcactggcgcagatgcggcgtgggagtggagctgggaaggacgcggaggagaggggtggcttttactcagctgctgagcgatggagtaaatatagggagattcaccgcgccctgagtataatttttagaggagtaaaaccgaacttttactcctctaaacagttatagggaattggttagaaatgtcctgagtagggacgaggttgaggccttcagggctgtttcgcgcgagggatagccctggttttttcttgcttcttagtttttcttacctttgtgtgctatacctctttggtttagatttttctgtatatgctgtgtgagctgatgtgcagttttccctttacttagtgaaaaagcagagcacctgctggtttgggtcaaaaacaaaatgcagctgtatttaggcggtatattacaggatacagaaaagtaaatctacagctcttcctagatgcaaaattcaaaataatcatgttttacactttttatgtgaaaaatgaatgcttacacatacatggaagataaagccattttgtaatgccagtgatagccacttcttcagttacataggtaaattccttctcaataagtaatgatagattttaatctcaagggcactgatattaatgggcatcgtgatgcaggcaggctgctgctacctgttctgtaaatcctgtcttcatatgctgcttgcac

SEQ ID NO: 120 - protein, 146 aa, Triticum aestivum
KEYFNEFAWVTVSQKFKGIDLLNDILKQITGASYESSKATDQIQENEIGKKIHDFLLQRRYLLVLDDVWEADTWEQINRAAKVSPDTNNGSRVLLTTRKKDVAHHIQMPTYVCDLKLMDEEKSWELFKSKALPSYRTYMICNPDKF

SEQ ID NO: 121 - protein, 926 aa, Oryza sativa
MDIALASAAATWLINKLLDRLSDYAIKKLLGSEGLDAEASSLRDALRRATLVLGAVPAGAAAGVRIGNDQLLPQIDLVQRLATDLARHLDELEYYDVKKKVKKNQKSSNPLSKMNLPLTQAGQSKPKYNRTDIKQIRDTVGYLHSICDDVHKALLLDKLDAIKQAAQDASTDKRETVDNFTENPRNKVFPREEMKDIIELINSAASSDQELLVVPIVGAGGVGKTTLARLVYHDPEVKDKFDIMLWIYVSANFDEVKLTQGILEQIPECEFKSAKNLTVLQRGINKYLTKRFLLVLDDMWEESEGRWDKLLAPLRSAQAKGNVLLVTTRKLSVARITSNTEAHIDLDGMKKDDFWLFFKRCIFGDENYQGQRKLQNIAKKIATRLNGNPLAAKSVGTLLRRNINEDYWTRILDSNEWKLQESIDDIIPALKLSYNQLPYRLQLLFSYCAMFPKGYNFDKGQLICTWIALGFVMNERKKLEDEGSDCFDDLVDRSFFQKYGVSQYYTVHDLMHDVAQEVSINKCLIIDGSDLRTVPSSICHLSIWTEPVYNEQSIERNDNFEEKLDAVQDNVLGSLECLILAGVYDENYSAKFVKTLERVRYVRMLQLTAMPFNSDILLSSIKKLIHLRYLELRCTSDKPKSLPEAICKLYHLQVLDVQHWSGLNDLPKDMSNLVNLRHLFVPGSGSLHSKISRVGELKFLQELKEFQVQEADGFEISQLGNINEIRGSLSILGLETVKKKGDATRARLKDKKHLRTLSLTWGSASGSTTTVQKEVMEGLKPHENLSHLLVYNYSGATPSWLLGDSFSLGNLESLHLQDCAAVKILPPFEEMPFLKKLSLVCMPCLKSIRIDFNSADEEDELELSEIEISKCLALTSIRLHSCKALTMLSINDCEALGSLEGLSFSEKLKQCVVQGCPKLPSGFIAN

SEQ ID NO: 122 - DNA, 1545 bp, Triticum aestivum
atgccgggcggggggttcgccgtgtcggcgccgtccggcgtggagttcgaggccaagatcacgcccatcgtcatcatctcctgcatcatggcggccaccggcggcctcatgttcggctacgacgtcggcatctcaggcggagtgacatcgatggacgatttcctgcgtgagttcttcccggcggtgctgcgccggaagaaccaggacaaggagagcaactactgcaagtacgacaaccagggcctgcagctcttcacctcgtcgctctacctcgccggcctcaccgccaccttcttcgcctcctacaccacccgccgcctcggacgccgcctcaccatgctcatcgccggcgtcttcttcatcatcggcgtcatcttcaacggggccgcccagaacctcgccatgctcatcatcggcaggatcctgcttcgttgcggcgtcggcttcgccaaccaggccgttcccctgttcctgtcggagatcgcgccgacgaggatccgcggcgggctcaacatcctgttccagctgaacgtgaccatcggcatcctgttcgcgaacctggtgaactacggcacgagcaagatccacccgtggggctggcggctgtcgctgtcgctggccggcatcccggcggcgatgctcaccctgggcgcgctcttcgtcaccgacacccccaacagcctcatcgagcgcggccacctggaggagggcaaggcggtgctcaagcggatccgcggcaccgacaacgtggagccggagttcaacgagatcgtggaggcgagccgcatcgcgcaggaggtgaagcacccgttccggaacctgctccagcgccggaaccgcccgcagctggtcatcgccgtgctgctccagatcttccagcagttcacggggatcaacgccatcatgttctacgcccccgtgctgttcaacacgctcgggttcaagagcgacgcgtcgctctactcggcggtgatcacgggcgccgtcaacgtgctggccacgctggtgtcggtgtacgccgtggaccgcgccgggcggcgcgcgctgctgctggaggctggcgtgcagatgttcctgtcgcaggtggtgatcgccgtggtgctgggcatcaaggtgacggacaagtcggacaacctgggccacgggtgggccatcctgttggtggtcatggtgtgcacctacgtggcctccttcgcctggtcctggggcccgctggggtggctcatccccagcgagacgttcccgctggagacgcggtcggcggggcagagcgtgacggtgtgcgtcaacctgctcttcaccttcctcatcgcgcaggccttcctctccatgctctgccacctcaagttcgccatcttcatcttcttctcggcctgggtgctcgtcatgtccgtcttcgtgctcttcttcctcccggagaccaagaacgtgcccatcgaggagatgaccgacaaggtgtggaagcagcactggttctggaagagattcatggacgacgacgaccaccaccacaacatcgccaacggcaagaacgccaccgtctga

SEQ ID NO: 123 - protein, 808 aa, Hordeum vulgare
MAAARKKIVVKVELKDDSQCRKALKALSALRGVYAISFNRGHGNITVVGEVNPEDVLARLQKKLFPNAQIVAVGPAKERSKYELTFEFLNRITNNFSEERIIARGGHGVVYKAVLDNGQYIAVKKLHLMPELDDEEFKNEFNNLMRVRHQNIIPLVGYCHHTKQVLVEHSGKHVSARVEERYLCSEYLEGGSLDKHLSNEPCALAWYTCYKIIKGICDGLLCLHKGFQEPIWHLELKPTKILLDKDMMPKIGGFGFSRLFDSIETSSTSEVRGTSVYMPPEYISKRLITSRFNVFSLGVIILQIMAGKESYTKCVDIPPEEFTERVYGFWVNRMPGTVSKHTSNEVKTCIEIALKCVESNRVNRPTINEIIQRMDKIDIVECSSLGDLYKTREFAFEFLEHITNVFSEQNIVGRGACGVIYKGVLDNGEEIAVKKLHQTLSIDDGLFKKEVNNVMRAEHKNIVRLVGYCHHISPIIVEHEGKHVSASVIERVICFEYMQRGSLDDQLSAESCKLDWDRCYKIIKGICEGLHYLHNAVPPIYHGDLKPGNILLDKDMVAKIGDFGLSRVFDTTQTYMTTSGVIKGTPGYMSPEYINEHKISLKSDVFALGVIIIKMMTGKEDYSNYAHTPREEFIEHVCKKWQVRLHATMRSHVFEEVRTCIGIALKCVEDDRTQRPTMAQILNELSNIGIVKRSPVDRETMSTHVSEEVRTCIEIVLKCVEDDRTQRPTIAQIVNELSKIGIAKGSSISQISQATSFSPEQTAQGGGHQVNKLTATPLEEKSRSCPGQACKELKLKRKVKLKLKRNVK

SEQ ID NO: 124 - protein, 686 aa, Triticum aestivum
MDYQGNNLSDFFQANGHLVLKRVDNNYKLRSFTEKEIEHITDRYSTSLGSGSFGDVYKGRLDDQRPVAVKRYKNGTKKEEFAKEVIVHSQINHKNVVRLLGCCTEENALMIVMEFVCNGNLYNILHCSNADGPILFPLDKRLDIAIESAEALSCMHSMYSPVLHGDIKPANILLDEKYLPKLSDFGIARLLSTDEAQRTKIVIGCIGYVDPLFCQSGILTTKSDVYSFGVVLLEMITRKKATDGTTSLTQCFAEAMGSGKKVRQLFDVEITYDKKKMKLIEEIVKLAVTCLRLDDKMRPTMVEVADRLRRIRKALPKHKGESSTGPPYADINNWHIRRGNAQDVPTISLDEMKKITRNFSNGALIGESSQGRVFFKVLKYGPESAFNSSQEIDLKIEAISRLKHENVVQLLGCWVEGDEYVLAYEYTLGGTLHDILHSKGKKGVRGAKSRAALSWMQRVKIALSAAEGLEFLHHKAEPQVTHGNIISSKILLFDNDIAKVGDAGISNVLVSDNMSRCHSFRCGLDLDRMDGHGYHEDDYHVDLYSATGQCNTKSDVYAFGVVLLELLTGRKAVDHTLPRGRQSLVTWVCTLGEKGLCTHCDKNPFIWAYINSMEDNVLTETSLSEDKVQRCVDPRLEGDYPHNAVTKMGAIAALCVHYNPDLRPNMSTVVKGLRQLLHSEPCDLVS

SEQ ID NO: 125 - protein, 741 aa, Triticum aestivum
MDGEASSNRHGILERMLLDDSAEPTDLPLSLLEDITDRFSPDQQIGSGGFAVVYKGMIGKRMVAVKKLSNTVDITESKFHGEVKCLMKTKHKNIVRFLGYCADTQGKMAEYEGKLVMADVRNWLLCFEFVPKGSLDKHMSDSSCGLEWRERYRIIRGICEGLCYLHEKRILHLDLKPANVLLDIGMVPKIADFGLSRCFDEGQTRAITQHLCGSQGYLAPEFYRGQIAFASDIYSLGVIIMEILTGAKGYFEEEHVVESWMNRLDQAPERHAQLEQVRVCTKIGIECMDLDPKKRPVAQHIIDRLDKTARADYSCQTGMSSSLAELQPSLLEEQSGEIGKLAAESLIKDINERPETEDHCQQGQENADQCSLQEAQDTERKVDRPGTGIFSSKSSFLEKLKDLNIFSRKARRNFVMNGGSHLQTVRGLTIFTKAEIQKITKNNSEFLGTGRFCKAYKGTLPDNTMVAAKTFITLSNNSLRREFEVIIEVHKELIHKNILKLYGCCPEMDVPTLVFEFAANGSLESIVHGSKQKLPLDLRIDIAIGSAEGLRYMHSYANYPMLHGDVRPINIFLDDKLTPKIGNFGLSRLYSLEEEMRLQASESSDARNQLMLLNMGYMDRKFMQDGHLTLKNEVYSFGAILLELITRKKNIFDENRILVDEYRKVYEREKSGRAMFDKEIATEDNIFALEEIGKVVIECLKEDSKERPDMTEVTELLVMIRRERRLLKARNKAITTSVPSV

SEQ ID NO: 126 - protein, 767 aa, Triticum aestivum
MDNEVNALEHILLDESAKPMQLSFSLLQDITNCFSDDRQIGRGGFAVVYKGMVRHAIVAVKKLTFNMEEKKFDKEVECLVKAKHKNVVRILGYCAETQKTIGDHEGKFVMADIRNWLLCFEYVPNGSLHKYITDASQGLEWRKRYEIIKGICEGLCYLHDKRILHLDLKPDNILMDDHMVPKITDFGLSRCLDEDQTQVTTTIIYGSIGYLAPEFFKGKFTFMSDIFSLGVTIVEILTGERGYPEDENVTESWINRLEGDTQLDQVRLCTKIGIECMRFDPKKRPSISHIVDRLDKTESIVEPVISGSSSEQQVSSERHCQERIRNTSADEIQDVAQCLQTLQNDQCQEKEDQRPVCGSHDMKQDRKDASISSYDSSAFQKLSILDIINRKSHRNFVRNGGPTIQQSKSVKIFREEELKTILNISNLVGRGAYGEVYGGLLGNKQVKVRKPIAGSLPDSEDFANEVIKRSQVTHTNILKLIGCCLEVDIPLLVYEFFSKDSLYDILHRNKKVPLNLGVRLRIAAQAADGVAYMNSEMNGKILFCGNLEASNVLLDDNFVPKISDFGLPWSVVGRDYYSPYFRPRQPAPPSRRPAPLIPRIMDYFIGRPAPSNGGYFIGRPADFGISGSASGQQPGDYFVGRPADQEFMEDNQLIQQSDVYNFGVIILELISRKKATHDETNSLVKNFLKSHVQGEKATSLFDKEIAERRNLAILYSLTEIAVECLSIDVDSRPKMTEIAERLLRLSRKYMTYGAAYSSDSISYSKYA

SEQ ID NO: 127 - protein, 722 aa, Triticum aestivum
MDYQGNNLNDFFQTNGHLVLKSVDNNYKLRSFTEKEIKHITKRYSTLLGSGSFGDVYKGRLDDQRPVAVKRYKNGTNKEEFAKEVIVHSQINHKNVVKLLGCCIEENAIMIVMEFICNGNLYNILHCGNADGPIPFHLHKRLDIAIESAEALSCMHSMYSPVLHGDIKPANILLDGKYLPKLSDFGIARLLSTDEAQRTKTVIGCIGYVDPLFCQSGILTTKSDVYSFGVVLLEMITRKKATDGATSLTQCFSEALGRGKKVRQLFDVEIANDKNIKLIEDIAKLAATCLRLDDKMRPTIVEVADRLRRIRKALPQRKSESSTGINNGLIRRGKAEDVPTISLDEMKKITRNFSNGALIGESSQGRVFFKVLKYGPEYAFKSSQEIDLKIEAISRLKHENVVQLLGYWVEGDKYVLAYEYASGGTLHDILHSEGIKSFWHRIKVWRLPHLAHSSPPPVPVSIHRAKRTTRRKELANPGRRQIGAKSGTILSWMQRVKIALSAAEGLEFLHHKAEPQVTHGNIMSSKILLFDNDIAKVGDVGISNVLVSDDMDSCHSFRWDLDTDRMNDHCYHQDDYHVDVYAATGQCNTKSDVYAFGVVLLKLLTGRKAVDHTLPRGRQSLVTWVCTLGKKNLCNHCDEKRFIWAYNFMLDNVLTKTSFSEDKVQRCMDPRLEGDYPRNAATKMGAIAALCVNYNPDLRPNMSTVVKGLRQLLHSEPCDLVA

SEQ ID NO: 128 - protein, 712 aa, Triticum aestivum
MDLEANSRHSILEQMLIDESAEPTDLPLSLLEDITDRFSPNHEIGRGGFAVVYKGMVGQGTVAVKRLTETLEIVHENKFHKEVECLMKAKHENIVRFLGYCAEARGKAASYEGNFVIADTRNRLLCFEYLPNGSLEKYITNASIGLEWKERFRIIKGICKGLHYLHMNRILHLDLKPANILLDGHMIPKIADFGLSRCLGEEKTHGTTKHLSGTPGYLAPEFYNGKFTFASDIYSLGVVIMEILTGAKGYSEDENVAASWMNRLDGNMQLEKLKVCTKIGIECMESDPKRRPFAWCIVNMIDKTASADETNMTSSLDERQVCLLNEQSDQERIGKLADTISHEDIKERPEIEVAAGSLGSDHSQEGQENTDHWSSCDLSTERKDNIQGTSISNSNSIVLDKLSILKIFNWGGHRNFVRNGGRQLKNSRGLRIFTKGEIKKITMNNSVVHGEGTFSRTYKGILPDITMVAVSTIMAGHYFLADDFIKSVEIQTQLIHKNILKLLGYCLEKDAPILVHEFAAKGSLKDILCDYENQILPLDLRLDIAIGSAEGLRYIHSTGIRHGNVKPDTILLDEMFTPKISDFVLSELVNTDGYIFTTAGGTILYMDPMIMKDGIVKLTQKDDVYSFGVVLLELITRMEIDTRKFCEIESGRRAMFDNDIAVEEDIPVLEEIGKLAFECLKGEVQRPDMTEVTKRVMMLRRDRILRKARKTN

SEQ ID NO: 129 - protein, 682 aa, Triticum aestivum
MDHPENIVTQLIHEEHRSKWIARSNHNVKCFTEDEIKRFTDNYKTLLGRGAFGEVYQGVLEDKSMIAVKRFIYNVRESFAKELIVHREINHKNVVRLIGYCVDESALMVVTEYIPKGNLSNILHQDSIPITLDTRLRIAIECAKALDYMHSQMYTQIIHGDIKPANILLDDGLGAKISDFGISRLINTENTLYTLNVIGSIGYMDPLFAQSGRLTAKSDVYSFGVVLLELITRKKARTEDGEIGLVESFSQSLSKGIRRVREMFDSEIATSSDMKTIEEIAKLAGKCLKMELTKRPHMLEVAERLRKLKKAARQVQERPTLFSWIWKNKQAPAKTPPLESSSSSQNARTVAPAEKMPSQESSGSTPKTGIVAALKAALSQVSHDSTQNVGTSIIGSTMTGQLFDLKDLLGASTEVLGKGTIGTTYRATLDSGYELVVKRLKDVDLEEAVFKRLVTLFGAIQNKHIVPLLWYYCSKDEKLLVHNVVPMGSLAKVLHGDQGSGPAQLDWEQRLAISLAAARGVQAIHLAGPSSCHGNIKSSNILLTGTHNACVSEHGLITLGIYYNASGYCAPEVTRNRWVSQKSDVYSFGILLLELLTRKSPLRKRFQDDKGVDLPRWVCSIIPEEWTAEVFDVELLAWGQKDGKEECMVRLMQLGLKCCSQDADSRPTMSDVVQRIEEIGQS

SEQ ID NO: 130 - protein, 703 aa, Triticum aestivum
MDHQENIVTRLIQEVHRSKWIASSNHDVKCFTEDEIRRFTNNYKSVIGKGAFGEVYEGVLEDKSMIAVKRFICNVKENFAKELIVHREINHKNVVRLVGYCVDENALMVVTEYIPKGNLSNILHQDSTPIALDIRLRIAIECAEALGYMHSQMYTQVIHGDIKPANILLDDELRAKISDFGISRLVNTENTLYTLNVIGSIGYMDPLFAQNGRLTAKSDVYSFGVVLLELITRKKARTEDGEIGLVESFILSLSKGFRRVREMFDPEIATLRGMKTMDEIAKLAGKCLRMEVSKRPEMLEVAESLRKFRKAPHQVQERPALFSWGRKNKPAPAETPSLGSSSISGIQIVGTVAPAKTPSLESSSSSQSVRTVAPAEMTPSQESNGSAPKTGIVASAKKPSEESSSNTRNVGSFIVRPTVTGQLFELDDLLRSSAEALGKGTVGTIYKVTLNSGHELVVKRLKDVDMPEPDFEQHAMLIGAIQNKHIVPLQWYYYSKDEKLLVYDIIPMGSLAKVLHGDEDSRPAPLDWEQRSAISLAAARGVEAIHLAGPSSCHGNIKSSNILLSGNHDAFVSEHGLITLVAMYPDASGYRAPELTSNMRVSQEADVYSFGILLLELLTRKAPTNSRKDLEGVDLLRWVCSVVREKWTAEVFDVELIGREQKVVEEECMVRLLQLAINCCSQDADRRPTMFEVVQQIEEIRQS

SEQ ID NO: 131 - protein, 677 aa, Triticum aestivum
MDHPKNIVTQHIQEERRSKWIAQSNHNLKCFTEDEIRRFTNNYKTVLGRGAFGEVYEGVLEDESVVAVKKFIQNEKENFAKEFIIHREINHKNVVRLVGYCSDANAQMLLMEYIPKGNLSNILHHDNIPIALDTRLRIATECAEALHYMHSYMNTPVIHGDIKPANILLDDKLGAKISDFGISRLVTSENTLYTQSVIGSIGYMDPLFARSGRLSTKSDVYSFGVVLLELITRKKARTEDEEINLVESFFHSLSKGFRRVREMFDPEIATSSDMKTIDETAKLAGKCLGMELSKRPEMLEVAESLRKLRKAAHHTQERIALFSWGRKQKLSPTEIPSLESSSNSQNMRTVATAEMTPSQESNGSTPKTGSVASAKDLSEGSSSSTRNVGTFIIRSTVTGQLFEMEDLLRASAEVLGKGTVGTTYKATLESGYEVVTKRLTGVELPNAEFEQHITLIGAIENKHIVPLQWYYCSTDEKLLVYDIIPMGSLAKVLHGDRDSGPSPLNWEQRSAISLAAARGVAAIHLAGPSSCHGNIKSSNILLTGTHDACVSEHGLITLGTYPNASGYRAPELIDNKLFSQEADVYSFGILLLELLTRKAPTNSITNKQGVDLPRWVYSVDWTAEVFDVELRGQEQKDGVEECMVRILHVAMNCCSQYVDSRPTMSYVVQQIEEILQS

SEQ ID NO: 132 - protein, 704 aa, Triticum aestivum
MGSGSKAASRKSTASWSSSSSWRSLLHGCLGGTMAAGENVPASDGLAEQPLPIVTNHDLPLAASNSNLHAFTFAELSAATEGFACCNQIGSGEFGTAYRGFIVDGVRPGLPAQLVAVKRTRWRVDDYVQGMVKEAMFLGELQLRHPCLVKMIGYCCEEEHRLLVYEFMAHGSLDDYFFKPFYRPLLPWSTRLSIVLATAKGLVSLHSAEKPLICGEFNASDILLDSDNNAKISLSGLRLDTRASDGSVTTTRSRLGTPRGSAPEYVVSGHLTTKCDVYSFGVLLLEILITGMKWIDMKRPEERDLLEHARPNLEDPVKLAGIMDKALKGIYPVAAAHKAALVTYKCLHVKPEDRPDMSDVMKTLDLLTAHLHRPTHGPELHRAAAGERRHRRHASGKGTTPKMNQLMIPIVANSREHGLMPAHTPVPTTDQTWRVDAGHHHMGTDMAYCQHSERSPSPSREREPTTTTPRNIWYMIGYCYEGLHRLLVYELMGHGSLANYLSNDIRVVLSWSTRLSIALATAKGLLSLHVEEKPLISVKFNASNILLDSYNNVKLSDLWFARKYGKGDDPNVYTLITSGYGFAPEYVMSGDFTKKSDVYCFGVVLLVILTGQRLAWLACASEQNLRNLRPRLRDPLKLGRVMDPVLKEIYPVAAAHDACMVAYRCLHASPGKRPSMLAVVEALDLLVGVTVTNEVDVGQTSTRP

SEQ ID NO: 133 - protein, 702 aa, Triticum aestivum
MGSGSKAASRKSTASWSSSSSWRSLLHDCLGGTMAAGENVPASDGLAEQPLPIVTNHDLPLAASNSNLHAFTFAELSAATEGFACCNQIGSGEFGTAYRGFIVDGVRPGLPAQLVAVKRTRWRVDDYVEGMVKEAMFLGEVQLRHPCLVKMIGYCCEEEHRLLVYEFMAHGSLDDYFFKPFYRPLLPWSTRLSIVLATAKGLVSLHSAEKPLICGEFNASDILLDSDNNAKISLSGLRLDTRASDGSVTTTRSRLGTPRGSAPEYVMSGHLTTKCDVYSFGVVLLEILITGMKWIDMKRPVKEERDLLEHARPNLEDPVKLAGIMDKALKGIYPVAAAHKAALVTYKCLHVKPEDRPDMSDVMKTLDLLTDAAVKEDQLPVPAPVSPNSNLHRFTFAELTAATGGFASGNKIGSGSFGTVYRGSLEDGIRPGLRAQPVAVKRARADDYHSEEHLKDSIFLGELQPRQPSLVKMIGYCYEGLHRLLVYELMGHGSLANYLSNDIRVVLSWSTRLSIALATAKGLLSLHGEEKPLISAKFNASNILLDSYNNVKLSDLWFAKKYGKGDDPNVYTLITSGYGSAPEYVMSGDFTKKSDVYCFGVVLLEILTGQRLAWLACASEQYPRNLRPRLRDPLKLGRIMDPVLKDIYPVAVAHDACMVAYRCLHASPGKRPSMLAVVEALDLLVGVTIVDEVDVGQTSTRP

SEQ ID NO: 134 - protein, 639 aa, Triticum aestivum
MDHPENIVTQLIHEEHRSKWIARSNHNVKCFTENEINRFTDNYKTLLGRGAFGEVYQGVLEDKSMVAVKKFICNVKEDFAKELLVHREINHKNVVRLVGYCIDENALMVVTEYIPKGNLSDILHGDSIHIALDTRLRIAIECAEALGYMHSQMYTQVIHGDIKPANILLDDGLRAKISDFGISRLVNTENTLYTLNVIGSIGYMDPLFAQNGRLTAKSDVYSFGVVLLELITRKKARTENGEIGLVESFIQSLSKGFRRVREMFDPEIATSSDMKTVDEIAKLAGKCLKMELNKRPEMLEVVERLRKLRKAPHQVQGRLAFFPLGRKNKLAPAETPSLESSSSTQNVGTFIVRSTVAGQSFELEDLLRGSAEILGKGTVGTTYKATLEGGYELVVKRLKGMHLPKADFEQHITVIGAIQNKHIVPLRWYYYSTEEQLLVYDIIPMGSLAKVLHGDRDSGPSLLDWEQRSAISLAAARGVEAIHLAGPSSCHGNIKSSNILLTGTHDACVSEHGLITLGVYSSASGYCAPEVNHNRSVSQKADVYSFGILMLELLSSKAPAKSIQNKKGLDLARWVCSITPEEWTEEVFDVELLGQQQKDGEVDCMLRFLQLALNCCSQDADWRPAMSYVVQQIEEIQQS

SEQ ID NO: 135 - protein, 769 aa, Triticum aestivum
MTSPGGFDGALQLQAGLHLSTTSSSSTKDNPTDEMSRCEAMEPTSMPLKLLEKITNNFSEERVLGHGAYGKVYRGVHDDRGDIAVKLLHNSMQTIDDKQFIHEFDNLMMLKHPNIVRFVGYCYETQRQHIQFEGRVVFGETTYKALCFEYMPKGSLQKHLSDECNGLDWQTRYNIIKGACEGLKYLHEGFEKPFYHLDLKPDNILLDENMTPKLADFGLSKLVGEEQTRITQSPIAGTLGYMAPEYLSESKVSKKLDIFSLGVVMTKIIAGPNGQTIYAEIPYKQFLDQVQGNWRKRLQTPWSSPESLEALCQQVKRCTEIALTCMEIDRHKRPSIVDIIHDLDQTEKNIENINSYEQDPSPPLDSSSNVVEPVASAPPTTPSPPPFLTQSYIGSSTPCPRPPPKNSPVMTPPPPPPPVPRGGIMELFGTFMHRKAKISGHGQRFTYNELASATHDFSKTQKLEEGAFWTVYKGTLTLQDKQGKKQEVSVAIKKNKHGMSDEAREAFKNEIDIMSPLNHHNIIRLVGWCDKRNNLLLVYELLEDRNLEAHLYGHGAHMDAEHSSARSPGSGFVLDWRKRLLNTDLCSVPSKYNILIGIASGLEYLHTKCMKCILHRDIKPENVMLDSGFNAKLCGFGLVMQLNHAMTSRSMDNIIKSQVYMDPAYRQNVGGNRESDVYSFGVLLLEVICGVKPKLTSIDKGTKNSLVEMVRECQERDAILDAADQRLRGEFDEEIKGVLFIGLRCVETRHGDRPTIEIVLDRLVSLTAK

SEQ ID NO: 136 - protein, 638 aa, Triticum aestivum
MNGNLVLFQDRTKHAVYINKNLKDFTEDAIERITSNYSIPIGKGGFGEVFKGVLDDELVAVKRYIRQELREEFMDEVSIHSQMSHRNVVNLIGYCIGENTLTMVTEFISKGNLDDILHNSSTSIPLDIRLGIAIGCAEALSYMHSMHLSGDNLVCHGDIKPANILLDANLTAKVSDFGLSRLLLGGITQYTRNVKGSIDYMDPIYLREGRLTPKSDVYSFGAVLLELIARKRVKEGSCSLISTFSNARGKGEWSRDLFDREIISAGNIKILEEIGKLATECLTLDIHKRPRITDVAKRLLLLWRQEKREFFFRTESVGTSNLMRCLGSFEMDVANSEILAKLGNMRFFTEKQLIEVTRNFSCLCSEGWLAEVYKGTLEDNTVVAVKKSVDAYEEHIIHFVNGVMIHAQLIHTNIIKLFGVCLEVGIPIFLYEYAAEGNLSDLLNGSKHFPLELRLEIAIGTAKALAYMHSSDSGCIRHGSVNPSNILLDHNFSPKVSGFSLSRALTIEYNYDDSVVVRRHYSDPSFVQCGLLTVKSDVYSFGIILMELISRKLSTYDEDCELTDLVILYNKAYDSEKRGAAMFDKDITADKDIILLEDIGKLAIECTKLGPDLRPTMKEVAERLEILRASWGKASQGR

SEQ ID NO: 137 - protein, 650 aa, Triticum aestivum
MDRKTSTSHIDILERLLLDESAEPTDLPLSLLRDITNGFSLGNKIGTGGYAVVYKGVVGKGMVAVKLLNTFGIHENKFQEEVKCLIKAKHKNIVRFLGYCADTQDATCGLNWRERYRIIRGVCDGLLFLHEKRILHLDLKPTNILLDGHMVPKIADFGLSRCLGEEQTRSITQNLWGTLGYMDPEYIRSRQITHASDIYSLGVIIMEILTGVRQYLKDEHVVQSWMIRLEASEGDMQLEQVRVCYKIAIECMDLDPKKRSVARHIVSRLDKMTSAEYLDETSIGSSVFELQISLPREQSGERIGKLAAESLQVDIEEGQQKLDQLPLQVVQAPLQGIGKLASESLQKADVEEHLEILVDVPQNLGRLHYDEDQKRVGQLSLWGGQNTTEKVNRHGASNSSSTSTGFNELNILGIDNKKAHMIFNRNNRRTLEQSHFLNILRKEELRPILRSSNLIRESGSTKVYKGVVDNTMVAVKKTFNAQNKQLEKEVIIHSQIIHKNIACLIGCCLEMDSPIRVYEFLPKGSLHGILHSGNKVPLNLDVRLNIVAESAQGLAYLHSQARTKIVHGDVKPASILLDENFIPNISGFGTSRLVERDGQHTRLIISDKTYMDPVYLQTGLLTEKSDVYSFGIVVLELISRKKATHTDDDW

SEQ ID NO: 138 - protein, 588 aa, Triticum aestivum
MDHEAGTSQVHVLDRLLLDENADPTNLPFSLLQDITNHFSVDHQIGSGGFAVVYKGVVGKCMVAVKKLSNTFAVPENKFHEEVRNLIKAKHKNIVRFLGYCADMQGKMEEYEGNLVMADQRNWLLCFEYVCNRSLDKHISDASCGLNWRERYQIIRGICEGLLLLHEKRIIHLDLKPANILLEAHMVSKICDFGLSRCLDKGQTRLITKSRCGTLGYMDPEYLRSGRTTFASDIYSLGTVILKILTGVKWYLEEETVVQSWMIRLEASVGDMQLEQVRVCYKIGIECMNLDSKKRPVAHHIIDRLDNMATADCSYETGTNSSLVELHPSLPSEQLGERLTTERLRKADAKEHSKILEDSSCGAQDTKQKANQHIANIFNSISTVFNKLNNLDIFNSKTRMCFNRNFMRHRLEQSATIMIFAKDELKPVLRSSNLIGKGPFDEVYKGVVDNAQVAVRKLYNGNAIMDDQFANEIIIWSQVNHKNIVRLIGCCLEMDTLILVYEFVPRGSLHDILYSNNKVSLSLDVRLTIAAESAQGLAYLHSQAFNQILHGRVKPASILLDDYFTPKISDFDLWGLIARDVDPVYLNR

SEQ ID NO: 139 - protein, 852 aa, Triticum aestivum
MSLRRLCFVLPMDGDEVLVASADDDHDDDARPRPGERLGSYVRDKVGRALSCLRCGCRDSRSAVGFEDMDGVYEVGARKIRGAAGPRVFSYSELYIGTSGFSDQEVLGSGGFGRVYRAVLPSDGTTVAVKCVASVGVDRFEKSFLAELAAVARLRHRNLVRLRGWCVRDEEELLLVYDYMPNRSLDRLLFAPASVAPGAPALGWDRRRRIVAGLAAALLYLHEQLDTQIIHRDVKTSNVMLDSEYNARLGDFGLARWLEHAVEDAPPTKKLEVLPSPPSVRSTSSFSSSANYQFRLIDTSRIGGTIGYLPPESFQRRGAATAKSDVFSFGIVLLEVATGRRAVDLAYPDDQIFMLDWVRRLSDEGKLLKAGDRKLPDGARAMFDMGRFIHLGLLCSLHDPRARPTMKWVVENISGSCSGDLPALPSFLALPKYISLTSSSDDSGTSTTIAGTNSTATSAASTKHMYATAAGTTIYLTAEDGRSPTGGSGENKSGNSQLSSPRPAVTVPNVDTPREISYKEIVEITNDFSESQVVAELDFGTGYEGFLDNGNGGRVHVLVKRLGMKTCPALRVRFANELCNLAKLRHRNLVQLRGWCTDHGEMLVVYDHSPGNLLSHHLLARHSNSGILSWRHRYGIVRALASAVLYLHEEWDEQVIHRNITSAAVFLDPDRSPRLGSFALAEFLSRNEHNNPHVVLPTGSGTARGIFGYMSPEYMESGEATTIADVYSFGVVVLEVVTGAMAVDMRSPEVLLVRKVQVGQEQDVRGVEALADRRLDGRLDRRELVRLAKLGIACTRSDPAARPSMRKVVSILDGNDEVLRKFERRMESREEWERKNAAALSLVRRLQALGIH

SEQ ID NO: 140 - protein, 731 aa, Triticum aestivum
MENESQHTSAMPRDFTFQLLKQITNDFSEDNRIGVGGYGVVYKGTLDSGEVIAVKKLYYKHPGLDSDKQFQNECTNLMRVRHQNIVRLVGYCHEIRHKCVEHNGKYVFAMVEDRALCFEYLEGGSLDKHLSDESCGFGWHTRYKIIKGICEGLNYLHNGSKESIFHLDLKPANILLDRNMMPKIGDFGLSRLFDSTETCSTKGIIGTPGYMPPEYINRFHITPKFDVFSLGVTIIKIMAGHQGYSKLADMSSQEFIQLVHEKWEKALQTTVLSHTSHGVKKCIEIALRCVEADRVKRPTIAEVVDELSKIDTAIIDELNEIDTARSSPIEQVTNLRSNQAFNPCVNSGTFSKGGGKDGKMISSCSSQAIRASSDSVLLSADIKCQILPSASVKIFSYDNLRLATRKFRANTLLGEGGFGRVYKGWIDENTLSPCKPGTGIIVAVKRLSQESLQGHQEWLAAEVNYLGHLSHPNLVKLFGYCLEDEHRLLVYEFIPRGSLDNHLYRRGPCQPLSWNLRMKVALGAAKALAYLHCAETNIIFRDFGSSHILLDRDYTAKLAGFGLAVNGPVGEESHLTTRVVGTHGYAAPEYIATGHLTQKCDIYCFGVLLLEMLSGLRVLDPNRPAGEQHLVDWARPYLEHKHKIRCVIDANLGGIYSFSAAQKIAALALECVCLDPKKRPTMDAAVSVLEGVQEDEEPEAAEHQESGKKVTASASRKNGKSRWNIFGGGRS

SEQ ID NO: 141 - protein, 707 aa, Triticum aestivum
MDLRESTVAEMIQRDDRSKWLSCSNHNIKCFTEGEIKRITSNYETIIGKGGFGEVYKGVLQDGRTVAVKRFMSNIEENFAKELKVHCEINHKNVVRLIGYCAKENALMIVSEYISKGNLSNVLHHERIPITLDTRLRIAVECSEALCYMHSQMYTQVIHGDIKPANILLDDNFNAKISDFGISRLVNTDSTLFTDHVMGSIGYMDPLFARSGRLTSKSDVYSFGIVLVELITKKKATIRNGEAGIVECFTQSLVTEKRKVRELFDVEISSQNNMKVLEGVAKLAGQCLRMEIDRRPEMRDVAERLRALRKTQVQVKQTPTIFPWGWRNKPAAQNNWQSSSSVTQQSLPYNLCHHFSLREVKSATRNFEKSHLIGVGLFGKVYYGVIDGGATKVAIKRGRFEQDVSMFQTEIAMMANLRHHHLVSLVGYCKEKNQRMLIYDYMARGTLTENLYANKMKEPPLTWRQRLDVCIGAARALHYLHECSIIPNDVSTTNILLDERLAGKFSSEVSPWRDAMDVTPTLRMGRLGCVDPEFYCTGQLTQKSNVYSFGVVLFEVLCARAAYNPNLPERQANLVYCALSCQKKGILDLIVDPDLEGKIAPWCFKKFVEIAEKCVSDRGIDRPTMQEVLENLELCLVEQSGSLGDEMLAEDDTNGPSRTERRLNLDMYLAEDDDSSHCSLVSTFEYDDMECASDGGVDSDSELLMPR

SEQ ID NO: 142 - protein, 673 aa, Triticum aestivum
MDHQAIIARSKLECMLFDENVEPMPLPLSLLEDITSSFSEDQAIGYGGFAVVYKGMLDNGTVAVKKLFETFCIDEKQFSEEIHCLMKAKHKNIVRFLGYCSNAQGEMVDYKGKLVLADVRERLLCFEYLRNGSLDKKITDASCGLEWRQRYQIIIGICNGLYYLHQKHIVHLDLKPENILLDDHMMPKITDFGLSRCFDEKQTRTVASKLIGTMGYLAPEFFGGRQITFKSDIYSLGIIIIDILTGEKGYVDVENQVLERWRYRLEKSHGDTQLVQVQVCTEIAIECCDFNPAKRPDMQDIINRLGATQNVVEFAAETGCSSSSVPKVAGSWKGGVPDHWIQLAQIQERESKKLHISLAKIKAATDNFHERNLIGVGGFGNVYKGALGDGTPVAVKRAMLTSEQGLPEFQAEIVLLSSIRHRHVVSLIGYCNEQAEMILVYEYMQRGSLRQHLYGSGEPALPALSWKQRLEICIGVAMGVHYLHAGCSENIIHRDIKSTNILLGDSNRGMIAKVADFGLSLTGPSFGHTHVSTIVKGSFGYLDPEYFRRQQLSDRSDVYSFGVVLFEVLCARPALNVSLPREQVSLADHALRCQRNGTLDDIIDPLLAGKIAPDCLKKFSETAWKCLSDYGVDRPSMGDVLWNLEYALQMQETFEKGISEGLDIPALQMLQMQ

SEQ ID NO: 143 - protein, 849 aa, Triticum aestivum
MSLRRLCFVLPMDGDEVLVASADDDDAWRRPRERMGSYVRGKVGRALSCLRCGCRDSRSAAGFEDMDGVYEVGARKIRGAAGPRVFSYSELYIGTSGFSDQEVLGSGGFGRVYRAVLPSDGTTVAVKCVASVGVDRFEKSFLAELAAVARLRHRNLVRLRGWCVRDEEELLLVYDYMPNRSLDRLLFAPASAAPGAPALGWDRRRRIVAGLAAALLYLHEQLDTQIIHRDVKTSNVMLDSEYNARLGDFGLARWLEHAVEDAPPMKKLELLPSPPSVRSTSSFSSSANYQFRLIDTSRIGGTIGYLPPESFQRRGAATAKSDVFSFGIVLLEVATGRRVVDLAYPDDQIFMLDWVRRLSDDGKLLKACDRKLPEGARAMFDMGRFIHLGLLCSLHDPRARPTMKWVVENISGSCSGDLPALPSFLALPKYISLTSSSSDSGTSTTIAGTNSTATSAASTKHMYATAAGTTIYLTAEDGRSPTGGSGENKSGSSQRSSPRPAVAVPNVDTPREISYKEIVEITNDFSESQVVAELDFGTGYEGFLDNGNGGRVHVLVKRLGMKTCPALRVRFANELCNLAKLRHRNLVQLRGWCTDHGEMLVVYDHSAGNLLSHHLLARHSNSGILSWRHRYGIVRALASAVLYLHEEWDEQVIHRNITSAAVFLDSDRSPRLGSFALAEFLSRNEHNNPHVVLPTGSGTARGIFGYMSPEYMETGEATTMADVYSFGVVVLEVVTGAMAVDMRSPEVLLVKKVQVGQEQDVRDVEALADRRLDGRLDRRELVRLAKLGIACTRSDPAARPSMRKIVSILDGNDEVLRKFERRMESREEWERKNAAALSLVRRLQALGIH

SEQ ID NO: 144 - protein, 736 aa, Triticum aestivum
MCHATAGTEEIEYTMENESQHSSTTPRDFTFQLLKQITNDFSEDNRIGVGGYGVVYKGTLDNGEVIAVKKLYYKHPGLDSDKQFQNECTNLMRVRHQNIVRLVGYCHEIRHKCVEHNGKYVFAMVEDRALCFEYLEGGSLDKHLSDESCGFGWHTRYKIIKGICEGLNYLHNGSKESIFHLDLKPANILLDRNMMPKIGDFGLSRLFDSTETCSTKGIIGTPGYMPPEYINRFHITPKFDVFSLGVTIIKIMAGHQGYSNFADMSSQEFIQLVHGNWEKALRTTVLSDTSHGVKKCIEIALKCVEADRAKRPTIAEVVDELSKIDTTIIDELNKIDTARSSTIEQVTNLRSNQAFNPCVNSGMFAKDGSMISSCSSRATRASSDSVLLSTNIKCQILPSASVKIFSYDNLRLATRRFRANTMTGEGGFGCVCKGWIDENTFSPCKPGTGIPVAVKRFNPESLQEHQEWLAEINHLGHLSHPNLVKLFGYCLEDEYRLLVYEFLPHGSLENHLFRRGSCQPLSWNMRMKVALGAAKALAYLHSTNIIVRDVKNSNILLDTDYNVKLTGLGLAVNGPVGEESHLSTRIMGTYGYAAPEYVATGRLTQKCDIYGFGVLLLEMLSGRRALDPNRPAEEQHLVDWARPYLKHKHKIRCIIDAKLGGIYSFGAVQKIAALALECVCLDPKKRPTMDSVVSVLEGVQEAEEPEAAEHQESNKKVTASRKNGKSRWNIFGGGPS

SEQ ID NO: 145 - protein, 852 aa, Triticum aestivum
MSLRRLCFVLPMDGDEVLVASADDDHDDDARRRPGEKLGSYVREKVGRALSCLRCGCRDSRSAADFEDMDGVYEVGARKIRGAAGPRVFSYSELYIGTSGFSEHEVLGSGGFGRVYRAVLPSDGTTVAVKCVASVGVDRFEKSFLAELAAVARLRHRNLVRLRGWCVRDEEELLLVYDYMPNRSLDRLLFAPASAAPGAPALGWDRRRRIVAGLAAALLYLHEQLDTQIIHRDVKTSNVMLDSEYNARLGDFGLARWLEHAVEDAPPTKKLELLPSPPSVRSTSSFSSSANYQFRLIDTSRIGGTIGYLPPESFQRRGAATAKSDVFSFGIVLLEVATGRRAVDLAYPDDQIFMLDWVRRLSDDGKLLKAGDRKLPDGAHAMFDMGRFIHLGLLCSLHDPRARPTMKWVVENISGSCSGELPALPSFLALPKYISLTSSSDDSGSSTTIAGTNSTATSAASTKHMYATAAGTTIYLTAEDGRSPTGGSGENKSGSSQRSSPRPAVAVPNVDTPREISYKEIVEITNDFSESQVVAELDFGTGYEGFLDNGNGGRVHVLVKRLGMKTCPALRVRFANELCNLAKLRHRNLVQLRGWCTDHGEMLVVYDHSPGNLLSHHLLARHSNSGILSWRHRYGIVRALASAVLYLHEEWDEQVIHRNITSAAVFLDSDRSPRLGSFALAEFLSRNEHNNPHVVLPTGSGTARGIFGYMSPEYMESGEATAMADVYSFGVVVLEVVTGAMAVDMRSPEVLLVRKVQVGLEQDVRDVEALADRRLDDRFDRRELVRLAKLGIACTRSDPAARPSMRKVVSILDGNDEVLRKFERRMESREEWERKNVAALSLVRRLQALGIH

SEQ ID NO: 146 - protein, 566 aa, Triticum aestivum
MDHREHVLRELIQGNDRSKWIAHSNHDVKCFTENEIKRITNNYNTELGRGAFGVVYEGVLEDRSMVAVKRFIHNRKENFAKELTVHREINHKNVVRLIGYCVDENALMMVTEYIPKGNLSDALHHNRIPITLETRLRIAIECAEALGNALMYTQVIHGDIKPANILLDDKLRAKLSDFGISRLVNTDNTLYTENVIGSVGYMDPLFALSGRLTAKSDVYSFGVVLLELITRKKARTDNVGISLVETFTQALAKGTRGVKEMFDPEIANRIDMKTIEEIGKLAGECLAMETDKRPDMLSVAMRLHKLAETPHQGQQWLSPFSWGRKHKPSSGEMIVGFGSKETALKLELKDLLEAVPEILGTGTVGTTYRAKFESGAELVVKRLKGVHLRRAQFEQRVTAIGDIQNEHMTPLRGYYYSSDDKLLLYDNMPMGSLSEALHGERGSGQALLGWEQRLAISYAAAQGVASIHSAGPSSCHGNIKSSNVLFTNTYDACISEHGLTALVSRPSESSAYSDPGITGRKWSVSQKADVYSFGILLLELLTGRFPGPGRGVSNLMRWVSSVIREE

SEQ ID NO: 147 - protein, 729 aa, Triticum aestivum
MENESQLASATPRDFTFQLLKQITNDFSEDNRIGVGGYGVVYKGTLDNGEVIAVKKLYYKHPGLDSDKQFQNECTNLMRVHHQNIVRLVGYCHEIRHICVEHNGRYVFAMVEDRALCFEYLEGGSLDKHLTDESCGFGWHTRYKIIKGICEGLNYLHNGSKESIFHLDLKPANILLDRNMMPKIGDFGLSRLFDSTETCSTKGIIGTPGYMPPEYINRFHITPKFDVFSLGVTIIKIMSGQEGYSKFADMSSQEFIQLVHENWEKALQTTVLAHTSHGVKKCIEIALRCVEADRVKRPTIAEVVDELSKIDTTIIDELNKIDTDRSSPIEQVTNLQCNQAFTPCVNSGMFSKDGGKDGSMISSCSSQAIRASSDSVLLRANIKCPILSSTSVKIFSYDNLRLATRKFHSNCVLGEGGFGCVYKGWIDENTLSPCEPGTGIPVAVKRLGQESSQGHKEWLAEINLAHLSHPNLVKLFGYCLEDEHRLLVYEFIPHGSLDNHLFKRDSCQPLSWNLRMKVALGVAKALAYLHCAEINVIVRDVKNSNILLDRDYTAKLSDFGVAVNGPVDQESHLSTAVKGTRGYAAPEYIATGLLTQKCDIYGFGVLLLELLSGRRALDENRPGMEQNLVDWARPYLRHKHKIRCVIDTSLGGLYSFSAVQKLAALALECLCTDPKKRPAMDSVVSILEGVQEDEELEAAEHQESGKKVTASASRKNGKSRWNIFGGGRS

SEQ ID NO: 148 - protein, 704 aa, Triticum aestivum
MDLRESTVVEMIQRDDRSKWLSYSNHNIKCFTEGEIKRITSNYETIIGKGGFGEVYKGVLQDGRTVAVKRFMSNIEENFAKELKVHCEINHKNVVRLIGYCAKENALMIVSEYISKGNLSNVLHHERIPITLDTRLRIAAECSEALCYMHSQMYTQVIHGDIKPANILLDDNLNAKISDFGISRLVNTDSTLFTEHVIGSIGYMDPLFARSGRLTPKSDVYSFGIVLVELITKKKATTRNGETGIVECFTQSLVTEKRKVRELFDVEISSQNNMKVLEGVAKLAGQCLRMEVDRRPEMRDVAQRLRALQKTQVQGKQTPTIFPWGWRNKPAAGNNWQSASSVTPQSLPSNLCRHFSLREMKSVTRNFDESHVVAQSGSGTVYYGVIDGGATKVAIKPCRGVSKFQTEIAMMAKLRHHHLVSLVGYCKEKNQRILIYDYMARGSLRGNLYANNTEEPPLTWRQRLDVCIGAARALHYLHECAIIPFVVSTTNILLDERLVGKFSSTVSLRQDSTDVTPTLHMGRLGCVDPEFYCTRQLTQKTNVYSFGVVLFEVLCARAAYDPYLPERQAHLVECALSFQKKGILDLIVDPYLEGKIAPRCLKKFVDIAEKCVSDRGIDRPTMQEVLEKLEMCLTEQSGSLDDETPDDDDTNGPSRTDRRLNLEMYLAEDDDSSHCGLVSTFEYDDMECASDGGVDSDSELLMPR

SEQ ID NO: 149 - protein, 673 aa, Triticum aestivum
MDLRESMVTEMIQGDDRSKWLSHSNHNIKCFAESEIRRITSNYETIIGNGGFGEVYKGVIQDGRIVAVKRFMCNVEENFAKELKVHCEINHKNVVRLIGYCAEENALMIVSEYISKGNLSDILHHECIPITLDTRLRIAVECSEALCYMHSQMYTQVIHGDIKPANIRLDDNFNAKISNFGISRLVNTGSTLFTDHVIGSIGYMDPLFARSGRLTSKSDVYSFGIVLVELITKKKAAIRNGETGIVECFTQALATGKRKVRQLFDVEISSQNNMKVLEGVAKLAGQCLRMEMDQRPDMRDVAERLLALRKTQVQGKQTLTTFPWAWRSKPAAQNNLQSSSPVMPQSLPSNLCRHFSLKELKSTTRDFDESHVVGQAGSGWVYYGVIDGGATKVVIKRGTVGQDVSKFLTKIAMIAKLRHLHLVSLVGYCKVENVVMLIYDYMAGGTLRENLYANNTKKRLLTWSQCLGVCIGAARALRYLHECSIIPFVVSTTNILLDERLVGKVSSAVSLQQDNTVTIYWRYGFIDPEFYRTGELTEKSNVYSFGVVLFEVLCARAAWDRSLPRRQAHLVQCALNCQKKGILDLIVDPYLEGKISPWCFKKFVEIAEKCVSDRGIDRPTMQEVLENLELCLADQSRSLGDEMPDDADADGPSRRERRLNLEMYLAEDDDSTQ

SEQ ID NO: 150 - protein, 733 aa, Triticum aestivum
MDRQASTSHIHVLERILLDENAEPTDLPLSLLKGITNGFSPAHQIGRGGFAEVYKGVVGKGMVAVKRLSRTFAVHENKFQEEVKCLIKAKHKNIVRFLGYCADTQGKMEEYEGNLVMADQRNWLLCFEYVCNGSLDKHITAATCGLNWRQRYQIIRGICEGLLFLHKKRILHSDLKPANILLDGHMVPKIADFGLSRCLGEEQTRYITQNLWGTLGYVDPEYIRSRQISFSSDMYSLGVIIMEIVAGIRCYREDEDVIQSWMIRLEALEGDIQLEQVRVCCKIAVECMDLDPKKRPVAQHIVNRLDKTASADYLDETSIGNSLFQPWVSCPREQPGERIGKLAAGSLQVDVEEHSEILEDVAESIEWLHFQDGQQKIDQLPSRGVQDTKQKVNRCGTSISSCIPNVFYKLNKLNIFHRKASRNLHSIDMHTLEKLHNIKIFTKEELKPIINSTNLIGRGVFSHVYKGYVDNTQVAVKIPFTYSSLQNLEFENQVVIMSQVSHKNIVRLIGCCLEAGSLMLVYEFVSNGSLDEILHSRDKVMPLNLDVRLNIVAESAQGLAYLHSQARAKTVHGDVKSANILLDDDFVPKISDVGITKLIDLSDWRYSSILVGGGSYIRDPVYVQTGMLTEKTDVYCFGIVILEVISGKKPNHYDDSSCGLATRFLDVHKEGKKATHLFDMDIAVTAGDLEILGHLAEIAVECINFDADQQRPTMTDVAERLLILNRSRRPQAV

SEQ ID NO: 151 - protein, 662 aa, Triticum aestivum
MDYQGSNVRDFLHVNGQVVLERVNTNYNLRSFTQKEIEDITGGYSTVLGEGGFGKVYKGKLDGLRPVAVKRYKNGTKKEEFAKEVIVHSQINHKNVVRLFGCCTEENALTIVMEFACNGNLYNILHCSRSDANGFVPFPLDKRLDIAIESAEVLSCMHSMYSPVLHGDIKPANILLDENFRPKISDFGISRFLSADETQHTRHVIGCIGYMDPLFCQSGILTSKSDVYSFGVVLLEIITRKKAVDGNVILAQSFVESLRKGKKVRLMFDEEIANDKKNIKFLEDVAKLVAECLKMEAKMRPEMVEVADRLRTIRKAYRQRKGRNSTGSNSGLIKSGKAQDMLSPTPVTAATAKNTDKIPSYVVPTISMDELKKITRNFSNDAVIGGLSSGCFFGVLNNGNKSAIKILSTEEVTLEIPVVSRFRHENILQLLGYCVEGDNFLLAYEYASRGSLHDILHGKKNVTGAEPGLVLSWTQRVKIALGAASGLECLHEKTEPCIIHSCIKASNIFLFDSDVAKIGYPGFSRHPHYIDNILLDRPDCPGGKYYPPSSAYDAPEYAMYGEFSTMSDVYSFGVVVLELLTGRKAFDPSLSRGQQCLVTWARPRLDESKVHQCVDPRLGGDFPPKAAAKMAAVAALCTQHEKEHRPKISIMVKALRPLLVSK

SEQ ID NO: 152 - protein, 701 aa, Triticum aestivum
MDTKIGTINKVDLERMVLDRSAEPTYLPLSLLEDITDCFSDDQQIGSGGFSIVYKGMVGEKMVAVKKLSQTMHENKFHKEVECITKAKHKNIVRFLGYCSDTQGRIEDYEGKFVMADVRNWLLCFEYVPNGSLIEYITDPSRGLEWRERYQIIKGICEGLLHLHEKRILHLDLKPSNILIDIHMVPKIADFGLSRCLDKDQTRDFTSNICGSLGYMAPEFFIGQVTFASDIYSLGIIIMEILTGEKGYQEEQDVVENWMNRLEAADQKETQLEQVRVCTTIGIECMDPNPKKRPFAHHIVNKLDKTASIIETCITSPSVEHQVRSLKEQHCQRKIVDLSLEYLLKEQHSQRKILDLSFEYLIKDMSGRTKTEELMEFIGAFKDHWRHAKEHQWSLRGVQGTKKNTSQQQGASISSSNSVVLNKLNIFSTKARRNYVRNGGPMLEKIDMLKLFKKEELKPAINDKNRIGRDVFEEVYIGLVDRVPVIVKKQISGTVLQNGQFAKEVIIQSQVLHKNIVRLIGCCVEVDIPMLVYEYLSKDSLHDILHNNCKENILLDDHFVPKISNFCISRLTGRGYKHTRTVKGDDPYMDPLYLQTGLLSEYSDVYSFGVVMLELLTRKKATHSGNNSLVRNFLENHKQGRKSTELFDEKIAVMENLELLDNLAQLVVECLSQNLDLRPKMIDVAKRLHILNESRGQWVLS

SEQ ID NO: 153 - protein, 670 aa, Triticum aestivum
MDYQGSNVKNFLHANGHVVLERVDNNYNLRSFTQKEIEDITGGYNTILGEGEFGKVYQGKLDNDRPVAVKIYKNGTKKEEFAKEVIVHSQINHKNVVRLFGCCTEVNALTIVMEFVCNGNLYNILHCSRSNANGSIPFPLDKRLDIAIESAEALSCMHSMYSPVLHGDIKPSNILLDENLRPKISDFGIARLLAADETQRTRYVIGCIGYMDPLFCQSGILTPKNDVYSFGVVLLEIITRKKAVDGNIILAQTFSEALRKGKKMRQMFDVEIANDKKNMKFLEDVAKLAAECLKMEGKMRPEMVEVADRLRTIRKAYHQHKGRSSAGSSSGLTISGKTEDVPSPIPITAATVNNTDRIPPSAVPTISMDDLKEITRNFSNDALIGEGSNNKVFFGVLEDGHKSAIKKPRPTTKNVLEVPMVSRFKHENVIQLLGYCVEGDNHILAYEYASRGSLFDILHGKKNVRGAEPGPVLSWAQRVKISMGAATGLQFLHKKTQPCAVHDGIKSSNIFLFDNDVAKIGWPGVYRQKPPIDNIFLDRINFTTGYGYDAPEYLMNGQLSTMRDVYSFGVVLLELLTGRKAVDHTLPCGQQSLVTWATPRLPECKVQECVDLRLGGDYPPKAVAKMAAIAACCIQYKADFRPRMSTVVRLLRTISADTEAHLESEASSKQ

SEQ ID NO: 154 - protein, 719 aa, Triticum aestivum
MDTEIIIRHKDDLERMLLDGSAEPTYLPLSLLEDITNCFSDAQRIGSGGFAVVYKGIVGKGIVAVKKLSQPYGMHEDKFLKEVGCLVKAKHKNIVRFLGYCSDTQGRLANYEGKVIMADLRNWLLCFEYVPNGSLDKYITDASCRLEWRKRYNIIKGICEGLLHLHELRILHLDLKPANILVDEHMAPKIADFGLSRCLDKEQTRVFTSNLCGSQGYLAPEFFGGQVAFASDIYSLGVIIVEMLTGKKGYSEDENVVDTWMNRLEGLDQWETQLEQVRVCIKIGIECMNSDPKKRPVASHITDMLGNIANAVETGIDSSSIEHQVCFLKEQYCEEKIADLSSESIGKDIKECFEMEELAEHVREDHWQEEEEEAPVDQWSLSWKLQSSSNSGMLHKLKNMDIFGRKARRDFYQRIGGSVLKRTNQFKFFEKRELKPVLKYENLSLKDGFGEIYKGLVDNVPITVRKLISKTVGDNAALLNEIIIQSQVIHKNIVRLRGCCLESDTPMLVYDFLSTDSLDDILHINIMVPLKLGVRLSIAATSAGALAYAHSKASTKPLHGDLKPANILFNGNFVPKIFGFGILRMTGMGTHNIDDMSYMDPVYLETGLLTEKSDVYSFGVIILELLTRKKASHSDNNSLVRSFLENHKQGRKTTELFDKQIAVTGDLVLLDNLAEIAVECLNLEAERRPEMKDVAERLERLKKVKHLQDELEQHVRHLK

SEQ ID NO: 155 - protein, 726 aa, Triticum aestivum
MDTKIRTVHKLDLERMVLDESAEPTYLPLSLLRETTDCFSDDRQIGSGGSAIVYKGTVGKGMVAVKKLLITIDMHENKFHKEVECLMKVKHKNIVRFLGYCSDTQGMVGHYDGKFVMADVRNWVLCFEYIPNGSLDKYITDASCGLKWRDRYHIIKGTCEGLLHLHEKRILHLDLKPGNILIADHMVPKIADFGLSRCLGEDQTRAFTSHLCGSQGYLAPEFYRGQFTFASDIYSLGIIIVEILTGEKGYPEEENVVANWMNQLEASDQWHTQLEQVRVCTKIGIQCMDLNPKKRPVVRHILDRLDKTKITIKTGISGSSVEQQVSFLKEQYCQEKNSKLSYQYLGKEIKEHTETEGLAEYVEIPREDHWQQGQQEASSDQWPLRGVQDVKKNVSPQGASISSSNNGVLYKLNNLDIFDRKALRNHVRYGGPTLENVNFVKLFKKKELSPILKNKNLIRRDSFGAVYMGLVDSVPVTIRKLFSGSVVQNEDFANEVIIQSQVIHENMVRIIGCCLEFEVPMLVHEFHSIASLHYILHINIKVPLNLGVRLCIAATSAGALAYVHPAVAKKILHGNVKPSNILLDNNFVPKISDTGISRLIVRGHEHSGISIGDMAYMDPVYVRTGLLTEQSDVYSFGVIILELVTRRKATHMDKNSLVINFLENHKQGRKSTELFDKEIAVTENLKLLDTLAGIAAECLNSDVDLRPTMVDVANRLSMLNRSCKLS

SEQ ID NO: 156 - protein, 792 aa, Triticum aestivum
MDGEMSVQHKVDLEHMLLDRSAEPTYLPLSLLEDITNCFSDDQQIGSGGFAVVYKGMVGKGMVAVKKLSKTFGVHENKFHTEVECLMKVKHKNIVRFLGYCSDTQGRTANYEGKFVMAELRNWLLCFEYVPNRSLDKYITDASHGLEWRKRYGIIKGTCEGLLHLDEKRILHLDLKPDNILLDDHMVPKIADFGLSRCLDKEQTRASTSNPCGSMGYLAPESFGGKLTFASDIYSLGVIIVEILTGEKGYPEDEDVVDNWMNRLEASDQWEIQLEQVRVCTKIGIECMDLDPKKRPVAHYIIDRLDKTASIIKTGITSSSVEQQVSFLKEPCREENFPKLSSKYLGKDIKKDLVMEEEELTECVGITLREKECVEIIREDHWQQEQEEVIDDKLSLWGPHDTTQNLSPQGASCSSSNAGVLNKLDNLDPWWSNPSPRAWARHISIKLRTICSYISLNNSHHLATNPMVVPRLSPATDLEINSKARMNYVKYGGPILENIECVKLFRIEELKPILKGDNFIGKGRFGEVYEGRVDNARLAIRKLISGTMPQEEQFVNEVIEQSKVCHRNIVKLIGICLDVDIPMLVYEFVSKGSLNDLLHSYHVVPVNLGVRLSIAAESASGLAYLHSMGSKKILHGDVKPANILLGHNFQPKISDLGTSRMIAGDYGHTGRIAQHVGRMAGVVAYMDPVYLQTGLLTEQSDVYSFGIVILELISRRKATESNNNSLVRNFLENHKQGRKATKLFDKEIAVTGDLDLLDSLAEIAVECLDYDVEKRPRMVDVERRLSVLNQSR

SEQ ID NO: 157 - protein, 668 aa, Triticum aestivum
MDNEGSNVKNFLHANGHVVLERVDNNYNLRSFTQKEIEDITGGYGIVLGEGGFGKVYKGKLDNHRPVAVKIYKNGTKKEEFAKEVIVHSQINHKNVVRLFGCCTDVNALTIVMEFVCNGNLYNILHCCSSNANGSIPFPLDKRLDIAIESAEALSCMHSMYSPVLHGDIKPANILLDENLRPKISDFGIARLLAADETQHTRHVIGCIGYMDPLFCQSGILTPKNDVYSFGVVLLEIITRKKAVDGNIILAQTFAEAPRKGKKMRQMFDVEIANDKKNMKFLEDVAKLAAECLKMEGKMRPEMVEVADRLRTIRKAYHQRKGRSSAGSNSGLTISGKTEDVPSPIPLTTATVKNTDGILPSAVPTISMDDLKEITRNFSNDALIGEGSNNKVFFGVLKDGHKSAIKKHRPTTKNILEVPMVSRFKHENVIQLLGYCVEGGNHILAYEYASRGSLYDILHGKKNVWGAEPGPILSWAQRVKISMGAATGLEFLHEKAQPSVVHDGIKSSNIFLFDSDVAKIGWPSVSRQPPIDNILLDRINFPPGYGYDAPEYVMNEQLSTMSDVYSFGVVLLELLTGRKAVDSTLPSGKSLVTWATPRLSECKVQECVDKRLGGDYPPKAVAKMAAIAALCVQYEADFRPRMSVVVQLLRTISADNEAHLESEASSKQ

SEQ ID NO: 158 - protein, 756 aa, Triticum aestivum
MDSDICIRHKVDLERMLLDESTEPTRLALSLLEDITNCFSDDEQIGSGGFAMVYKGMVGKGMVAVKKLSNTFGVHENKFYKEVECLMKVKHKNIVRFLGYCSDTQGRTANYEGKFVMAELRNWLLCFEYVTNGSLDKYITDAYRGLEWRERYNIIKGICEGLLHLHEKRILHLDLKPGNILVDDHMVPKIADFGLSRCLDKEQTRASTLNPCGSMGYLAPESFGGKLTFASDIYSLGVIIMEIMTGEKGYPEVDVVKTWMNRLEGSDQMEAHLEQVRVCIKIGMECIDSDPKKRPVARHVKDRLDKITSTMETGISSSSFEQVSLLKEQCCEEKVAKLSSEYLGKDIKEHAETEELAKYIGAPKEDHWQQIREKAPGDQWSLWGAQDTNQNVIPHWQQGREEVPGDQWPLWGAQDTKRIDIPQGASSSSSNSGFLYKLNNLDIFNTKARRNYERYGGLTLEKTRTVRLFRKGELKPFLKDKNLIGKGRYGEVYRGLVDDFAPVVVRKLISGTVPEDGGLFPNEVEIQCRVIHKNIVRLIGCCLEVDTPMLVYEFLSRGSLSDILHSNKVSLNLDLRLSIAAKSSHGLAYMHSMASSSNILHGNFRPSNILLNDNFEPKISDFGMSRMAVPHTGIVAGDMVYMDPVYLQTGVLTKQGDVYSFGVTILELVTRKRANSLVRIFLENHKQGKKSTDLFDKQIAVTEDLELLDTLARIAVECLNHDEDLRPTMVDVAKRLSILNRSRNVGGLVDASTSGV

SEQ ID NO: 159 - protein, 726 aa, Triticum aestivum
MDTKIRTIHKVDLERMVLDESAEPTYLPLSLLQEITDSFSDDQQIGSGGSAIVYKGTVGKGMVAVKKLSITIDMHENNFHKEVECLMKAKHKNIVRFLGYCSDTQGMVGDYDGKFVMADVRNWVLCFEYIPNGSLDKYITDASCGLKWRDRYRIIKGSCEGLLHLHENRILHLDLKPGNILIADHMVPKIADFGLSRCLDEDQTRAFTSHLCGSQGYLAPEFYRGQFTFASDIYSLGIIIVEILTGEKGYPEEENVVANWMNQLEASDQWHTQLEQVRVCTKIGIQCMDLNPKKRPVARHILDRLDKTEITIETGISGSSVEQQVSFLKEQYCQEKNSKLSYQYLGKEIKEHAGTEGLAEYVEIPREDHWQQGEQEASSDQWPLRGVQDVKKTVSPQGASISSSNNGVLYKLNNLDIFDRKAHRNHVRYGGPTLENVNFVKLFKKKELSPILKNKNLIRRDSFGVVYMGLVDSVPVTIRKLFSGSVVQNEDFANEVIIQSQVIHGNMVRLIGCCLEFEVPMLVHEFHSTANLHYILHINIKVPLNLGVRLSIAATSAGALAYVHSAFATKILHGDVKPSNILLDNNFVPKISDIGISRLIVRGHEHSGACIGDMAYMDPLYVRTGLLTEQSDVYSFGVIILELVTRRKATHMDKNSLVINFLENHKQGRKSTELFDKEIAVAENLELLDTLAGIAAECLNFDVDLRPTMVDVANRLSMLNQSCNLS

SEQ ID NO: 160 - protein, 660 aa, Triticum aestivum
MELVEEKIREFIKSNERAKWRPVNNHNINNFTEDEIKMITKNYRNPIGKGAFGEVYRGVLDDGSTVAVKKYICQNLKDGFAKEITVHCQINHKNVVRLLGYCLEENALMMVTEYIPGGNLKDLLHGSDDHISLDARLGIAIECAEALACMHSLSQPIIHGDIKPDNILLDENWGAKLSDFGISRLLCMDGTDYTMHVAGSRGYMDPELFETGRVDPRNDVYSFGVVMVELVTRAKVNENGMSTGVTRNFTQAIEKGKTARTMFDTKIASVSNMKVLYKIGKLAAECLRRDIKNRPEMKDVTERLRALRKAYCQQDQEKTGQWSMKNVNRKGQSISGSKSTMLYKLNNLGMFSIWNARRNFMRNAGPTVDQIQNLRVFTKEEIRKITNGYSSDVIAKCSSCEVYRGTLEDNKLVGVNIETVMVDEAHSEHFINSMLIYSTILHNNMVKLLGCYLEADVPILVHEFAANGNLQDILRGNYSFPLGIRLDIAVGCAEALAYLHSKSFAFVGANITPANILLDDSLVPKVSGLLFICHGITSTSSDVYCFGTLLLELITRKQGGYRNNSPQELRKAYMKEGHTMFDKEIAAKANMFILERIQMVAMDCLKLDELARPKMAEVAERLLRLKNVESKGSELQELSMLRRLVASSISKARENTTPAT

SEQ ID NO: 161 - protein, 714 aa, Triticum aestivum
MDTSTRSGPLHRHRLPRNPGHRSFYRTVTPPSCMPWWQVRKLYLEISYITLVHIMERFEDMIREFIKSNERAKRRPVNNHGINNFTEDEIKMITKNYKNPIGKGAFGEVYRGVLDDGSTVAVKKYICQNLKDGFAKEITVHCRIDHKNVVRLLGYCLEENALMIVTEYIPGGNLKDLLHGSDDHISLDARLGIAIECAEALTCMHSLHQPIIHGDIKPDNILLDENLGAKLSDFGISRLLCMDETAYTMHVAGSRGYMDPELFETGRVDPRNDVYSFGVVMVELVTRAKVNENGMSTGVTRNFTQAIEKGKTARAMFDTKIANVSNMKVLDNIGKLAAECLRRDIKKRPEMKDVTERLRALRKAYCQQDQEKTGRWSMKNVNRKGQSISASSNSTMYYKLNNLGMFSTWNAPRNFMRNAGPIVEQMQNLRVFTREEIRKITNGYSSDVIAKCSSCEVYKGTLEDNTLVAVNIETAVDEAHSESFTNSMLIYSIILHNNIIKLLGCYLEADVPILVYEFAANGNLQDILRGNYSFPLGIRLDIAVGCAEALAYLHSRSFAFVGANVTSANILLDDSLVPKVSGPLFICHSISSTSGDVYSFGILLLELITRKQGGYRNNSPQELRKAYMKKGHTMFDKEIAAKADILILERIQMVAMDCLKLDALARPKMAEVAERLQRLKNVESTGSELRELSMLRRLVASSISKARENTTPAT

SEQ ID NO: 162 - protein, 676 aa, Hordeum vulgare
MEQKVEIPESKLKDYIQDTDKTKWRLKNNHNIKYFSEDEIKRITSNYSTKLGNGAFGEVYKGVLDDDQWVAVKKYIRLDSQEEFAKEVIIHSQINHKNVIRLVGCCIDENAQTMVLEHASNGNLSDRLHCHDNPISLATRLNIAIECAEALGCMHSMYNPVIHLDIKPSNILLGDDFHAKISDFGISRLRDNIESAINVIGCIGYMDPAFRQEGCLITVKSDVYSFGVVLVELITKTKPTDETKRVIQRFGKAFTKGRPVRDLFDADIANKSNTKVLEAIGAIANKCLNEEYDARPEMNDVAGRLRDLRAVLESGQGKSQTGWRFFNGGQNELKTEKPGVAWSSIFSRNTTIFKKGYPAPAGIPRYSYGDLKMMTKNFIDVLGRGAYCTVYRGHLPDGRAVAVKQLYGVGGSEVEFWSEVTIMARMNHRNIVSIWGWCADKGQRMLILEFISNGSLDKHVLPASTQEDDGPGQRQHLDLNTRHQIALGVAHAMAYMHEECSDGVLHCDIKPHNILLDDNFCPKLTDFGLSTWLSKTMSRVRGTRGYMAPEWVIHREVITAKADVYSFGMVLLEVVSGRNYNFREESVGSEDWYFPKWVYEKCYIHHKIEDILDPILQAEACQGTGIAELMVNTAIWCLQDRAEKRPSMGKVVKMLDGTIEMTKQPEKPVIFCACDD

SEQ ID NO: 163 - protein, 791 aa, Hordeum vulgare
VGSKHMRDEKQPQFCGSSVPRRLLGSLERLLPAKSKMDQPELEVSEIDELERIVGDAGAKARRLKLSLLEHITNGFSNKSEIDRGGFAVVYLGVLPSGLHIAVKKFYSMPGWDESAFENEISIIMKVAHENIVRLIGYCDHTNHEQMEYNGELVLAEYRQRFICTEYIPNGILATHITDEFHPRLDWDQHYQILKGICRGLFHLHHKVHIFHGDIKPGNILIGDNFVPKIYDFGLSRSLCEGEPLNYDGENACGTLAYMPPEMLEYGRWSTKSDIYALGVTITELLTGKRRWHRGLTVERELKELRKRLVRKGVFLSWENKYHQVRTCLEIAHTCMENDPEKRPTALDIIQSLDRTESVNCSAQLLWQSGDEESDTSDTEALETETTTEILEENPDSPDMTGETCTQEPDKSELVIELPASVDLSDLKVLEKITDDFSHERIVGKDGTFKGFQHKAFVYKGDIPRGEIIAVKRLIGVEIPVEKFKREAHEFTRLDHMNIVKVAGYCHDQSRRHKLVHFKGEPLPQLIKGAEQLLCYEYMHNGSLHDYLIGHGSRQIDWEMRYKLIKGTCAGLHYLHKGRENCPIFHLNLSPSNVLLDENYIPRITGFDFSKLIGEKNTKSVVLKLNGPIAYLPPDFFHSKGTDLKYLATVDIYSLGLIILEIATQQEIKGNHGVLIKSIEENWREDSQITRLYTSLEADELRQVKMCIHIGLRCVQSKPEKRPTAEDIKLWLKEGIKEGGGVVSRPTVPVPRTGPGGVPRSPVPTNITHADDRIQGNEKPAGFMRRFFRRK

SEQ ID NO: 164 - protein, 742 aa, Hordeum vulgare
MDCEASSNRHGVLERMLLDESAEPTDLPLSLLEDITNHFHPDQQIGSGGFAVVYKGMIGKWMVAVKKLSNTVDITESKFHGEVKCLIKIKHKNIVRFLGYCADTQGKMAEYEGKLVMADVRNWLLCFEFVPKGSLDKHMSDASCGLEWKERYRIIRGICEGLHYLHEKRILHLDLKPANVLLDIGMVPKIADFGLSRCFDEGQTRAITQHLCGSHGYLAPEFYRGQITFASDIYSLGVIIMEILTGAKGYFEEENVVKSWMDRLDQVPEGHTQLEQVRVCTKIGIECMDLDPKKRPFVQHIIDRLDKTARTDYSCQTGMSSSLAELQPSLLEEQSGEIIGKLVAESLIKDINERPEKEDHCQQGQENADQWSLREAQNTERKVNRPGTSIFGSKSSFLEKLKNLNIFSRKAHKNFVRNGGPHLQNVRGLTIFTKTEIKKITKNNSEFLGTGRFGKVYKGTLPDNTLVAVKTFITLSDDMRREFEVIIDMHKELIHKNIRKLYGCCLEVDVPMLVFEFAAHRSLQDILHGSKQKLPLDLRIDIAIGSAEGLRYMHSYANQPILHGDVRPDNIFLDDKLAPKFSNFGLSKLYCIEKKRMLQASESKDTRNQLMLLNMGYMDLEFMITGRVTQKSEVYSFGAILLELITRKENVFDENCILVTEYRKLYERGKSGRAMFDKEIASEDEDIFALEEIGKVAIECLKEDSKERPDMTEVMEQLMMIRRNRRLVQARNKAMTTSGPSV

SEQ ID NO: 165 - protein, 850 aa, Hordeum vulgare
MSLRRLCFVLPMDGDEVLAASADDHDDDDARRRPGEKLSSYVRDKVGRALSCLRCGCHDSRSAKMSFEDMDGVYEVGARKIRGATGPRVFSYSELYIGTSGFSDQEVLGSGGFGRVYRAMLPSDGTTVAVKCVASVGVDRFEKSFLAELAAVARLRHRNLVRLRGWCVRDEEELLLVYDYMPNRSLDRLLFAPASAAPALGWDRRRRIVAGLAAALLYLHEQLDTQIIHRDVKTSNVMLDSEYNARLGDFGLARWLEHTVEDAPPTKKLELLPSPPSVRSTSSFSSSANYQFRLIDTSRIGGTIGYLPPESFQRRGGATAKSDVFSFGIVLLEVATGRRAVDLAYPDDQIFMLDWVRRLSDEGKLLKAGDRKLPEGARAMFDMGRFIHLGLLCSLHDPRARPTMKWVVENISGSCSGDLPALPSFLALPKYISLTSSSSDSGTSTTIAGTNSTATSASSTKHMYATAAGTTIYLTAEDGRSPTGGSGENKSGNSQRSSPRPAVAVPTVDTPREISYKEIVEITNDFSESQVVAELDFGTGYEGFLDNGNGGRVHVLVKRLGMKTCPALRVRFANELCNLAKLRHRNLVQLRGWCTDHGEMLVVYDHSPGNLLSHHLIVRHSNSEILSWRHRYGIVRALASAVLYLHEEWDEQVIHRNITSAAVFLDPDRSPRLGSFALAEFLSRNEHNNPHVVLPTGSGSARGIFGYMSPEYMETGEATTMADVYSFGVVVLEVVTGAMAVDMRSPEVLLVRKVQVGQEQDVRDVEALADRRLDDRFDRRELVRLAKLGIACTRSDPAARPTMRKIVSILDGNDEVLSKFERAMESREDWERKNAAALSLVRRLQALGIH

SEQ ID NO: 166 - protein, 692 aa, Hordeum vulgare
MDLRESTVTLMIQRDDRSKWLSYNNHNINCFAEGEIRGITSNYKTIIGKGGFGEVYKGVLEDGRIVAVKKFMCNVEENFAKELKVHCEINHKNVVRLIGYCAEENALMIVSEYISKGNLSDVLHHECIPITLDTRLRIAVECSEALCYMHSQMYTQVIHGDIKPANILLDDNFNAKISDFGISRLVNTDSDVFTEHVIGSIGYMDPLFARSGRLTSKSDVYSFGIVLVELITKKKATIRNGEAGIVECFTQALLTGKRKVRELFDVEISSQNNMKVLEGVAKLAGHCLRMDMDRRPEMIDVAERLRALRKTQFHGKQTLTIFPWGWRNKPAAQNNCQSSSSVTPQSLPSNLCRHYSLREMKSATNNFDESHLVCVGGSHEVYFGGIDGGATKLAIKRASVEKDVNKFHIEIAMIAKLCHHHLVSLVGYCKEENEKILIYDYMVRGTLRGNLYDNRTEEPPLTWRQRLDICIGAARALHYLHECSIVPNDVSTTNILLDERLVGKVLSKVSLPQDVTREIGKGCFDPELFLTWELTEKSNVYSFGAVLFEVLCARAAWDPSLPKRQANLVECFLDCQKKGILFLIVDPYLEGKIAPRCFKKFVEIAGKCVSNRGIDRPSMQEVLENLEVCLAEQIGSLGDEMPDDNNINYDLSRKEQQLNLEVYLSEDDDSSCCSEISAFGVADSMDSELLMT

SEQ ID NO: 167 - protein, 669 aa, Hordeum vulgare
MDYQGNNVRDFLHVNGHVVLEKVDNNYNLRSFTEKEIEGITSGYSTVLGEGGFGKVYKGKLDDHRPVAVKRYKNGTKKEEFAKEVIVHSQINHKNVVRLFGCCTEVNALTIVMEFVCNGNLYDILHCTSNANGSVPFPLDKRLDITIELAEVLSCMHSMYSPVLHGDIKPANILLDENLRPKLSDFGIARLLAADETQHTIHVIGCIGYMDPFFYQSGILTPKSDVYSFGVVLLEIITRRKAVDGDIILTQSFAEALRKGKKVRQMFDGEIMNDKRNMKFLEDVAKLAAECLKMEGKMRPEMVEVADRLRTIRKAYHQVKGRNSTVFANTGSNSGLTPYVVPTISMDELKEITRNFSNDALIGADLYGQMFSGVLRNGHKSMIKKLRPGEEFILEVPVVSRFIHENVLQLHGYCVEGDNYVLAYEYASRGSLHDILHGKKNVGGAEPGLVLSWEQRVKIAMGAATGLQFLHNKAQPCIIHGGIKSSSIFFFDSDIAKIGYPGVSRKTRAHIKNIFLDCPPGCPQTTSFGPDAPEYATKCFNAVLDSFTRFGESLHPTYTVFCPVRYAMTGQLSTMSDVYSFGVVLLEILTGRKAIDFTLPHGQQSIVAWAIPRLDEVKVRKWVDPRLGGDYPPKALTKMAAVARHCVEWEPEHRPNINKVVEALKPLLL

SEQ ID NO: 168 - protein, 797 aa, Hordeum vulgare
MDRESNAKHSVLELMLLDASAEPMDLPLSLLEDITNGFSHDQQIGSGGFAVLYKGILGKVTIAVKKLSKTFDNHEKQFHEEVSCLMKAKHKNIVRFLGYCSDTRGKMVAFEGKLVMADVRQRLLCFEYLPRGSLDKYIAGSSYVLQWKESYQIIKEICEGLHYLHVERRIVHLDLKPTNILLDCNMVPKIADFGLSRRFCEKQSQILTAEVKGTLGYMAPEFVNNGQITFKSDIYSLGIIITEILTRQRGYRDVEDVLDIWRNRLQESQREIHLEQVRVCTEIAKECSDYNPANRPAIQDIINRLDETESVGGSIETRGSTLSVAQEEKDPSEQHQWTPKVPGEASDEDCRMEVGTILMKRYEIGRLIAQGDLAKVYYAQNLTSEQDVAIKMIDKDKVSSVELMVRIKREMTLMNLLGHPNVLKLVEVMASKSKLYFVLEYPKGGDLSTKIVTGGLHEDAARKYFRQLISAVEYCHSQGVYHRNLNLENILLDENGNLKISDFGLSVLPGSREDGLFHYPCGTPAYVAPEVLSWRGYAGAKVDIWSCGVILFVLVAGYLPFQGTDATDLFNKISLGKYECPSWISVKLKDILCKILDLDPSTRASVSSIKASAWYRNHIEVKACKGEATTSETTECSMLSKGKTKCSNSVGNQAPSSFTHSNAVGVISLSVKFYLSNLSEKKYGLWENKFTARLPAETLFARINELAEQLKLKVKKKENGILKLVASEEGMGRLELDAEVFELAPSFLLVEIKITNGDKEYELQMKVKDAVRLIFKDMVWAWQDDSHSQQPQFTLFR

SEQ ID NO: 169 - protein, 866 aa, Hordeum vulgare
MMRRMVMKVALEDRSQQRKALKAVSTLHGTASLPLLLFPDPGFSLLSSLVPEFVSRKGIDAIAADLRCGTITVVGVVDPVDVVAKLRRLFANAQIVSVGPAKEEKKDGDKKDGADKKKPVPVPPVYYPFPYYPPPRPRYEFTVGFLNSITDNFSEARIIVRGRHGIVYKGVLDNGQYIAVKKLHLMPGLDDEEFKNEFNNLMRVRHQNIIPLVGYCHHTKQVLVEHNGKHVSARVEERYLCSEYLEGGSLDKHLSNEPCALAWYTCYKIIKGICDGLLCLHKGFQEPIWHLELKPTKILLDKDMMPKIGGFGFSRLFDSIETSSTSEVRGTSVYMPPEYISKRLITSSNVFSLGVIILQIMAGKESYTKCVDIPPEEFTERVYGFWVNRMPGTVSKHTSNEVKTCIEIALKCVESNRVNRPTINEIIQRMDKIDIVECSSLGDLYKTREFAFEFLEHITNVFSEKNIIGRGACGVIYKGVLDNGEEIAVKKLHQTLSIDDGLFKKEVNNVMRAEHKNIVRLVGYCHHISPIIVEHEGKHVSASVIERVICFEYMQRGSLDDQLSAESCKLDWDRCYKIIKGICEGLHYLHNAVPPIYHGDLKPGNILLDKDMVAKIGDFGLSRVFDTTQTYMTTSGVIKGTPGYMSPEYINEHKISLKSDVFALGVIIIKMMTGKEDYSNYAHTPREEFIEHVCKKWQVRLHATMRSHVFEEVRTCIGIALKCVEDDRTQRPTMAQILNELSNIGIVKRSPVDRVQETMSTQVSEEVRTCIEIVLKCVEDDRTQRPTIAQIVNELSKIGIAKGSSISQISQATSSSPEQTTQGGGHQVNKLTATPLEEKSRSCPGQACKELKLKRKVKLKLKRNVK

SEQ ID NO: 170 - protein, 603 aa, Hordeum vulgare
MQGLDNEEFKNEFNNLMRVQHQNTIRLVGYCHHTAQVPVERNGEHISARVEERALCSEYLPGGSLDRHLSNESCALDWHICYNIIKGLCEGLHYLHEGFGYPIYHLGLKPSKILLDKDMMPKIGGFGFSRHSTETFNTSDVTGTSVYMPPEYISTRQITPKFDVFSLGVIILQIMAGKQSYIKCADIPPEEFIELVYELWVNRLQATISKRTSREVRTCIRIALKCVEFNLMKRPTTNEIIQELNKIDIVEWSFEFLERITNGFSEQNIVGRGGYGVIYKGVLENGEEIAVKKLHPVLWIDDEQFKNELNILTRVKHKNIVQLAGYCHHTSQIVAEYKGEHVSASVVERAICLEYMHGGSLADQLSAEACTLDWDKCYKIIKEICEGLHYLHNVDAPIFHLDLKPANVLLDKDMVAKLCDFGLSRLFDSMQTYITESQDMKGTRGYMPPEYINRQQISPKFDVFSLGVIIIQIMAGKDGYFNCADTHPKVFIKHVRKKDPISGKEIPNILLCLTPIRACLFWHYVSILQVCENWRMRMEANMPSHVSQVRTCIKIALKCVEDDRTRRPTIAQIVNELSNIGIPKSKPIRQWANKLTSLKTFLT

SEQ ID NO: 171 - protein, 740 aa, Secale cereale
MDGYEFERAELAALERAVGDPSAKAMSLTFSLLRRLTNDFSRDHRIGCGAFSVVYKGVLPSGSRIAVKKLHSAIGMAEDEFENEVFITMRVAHKNVVRLIGYCSHTQSGIFECDGKSVFAEARQRLICTEYVPEGTLDKYITDEFHGGLDWNHRYKVLKGICHGLRYLHDEVRIIHRDIKESNILLGDNLVPKIFDFGFSTSLREGESLSVDERIHGTIGYMAPELVTDRTYSCKSDIFSFGVVMMKLLIGSTWASENRNVELILEKLRKRLVKGAFSSWKNNYHQVRTCLEIVYSCMDMDPDKRPTALEIIQRLDETESTDYSVSSGHAPPLWQPGDEESDSSDVDASELERTPSNDILPSDEEPTSADTTGESSTQEHNMSALVSKLSGSTELSSLDFLERITDGFSYERIVGKDNLDAVYHKAFVYEGNISGQTMVAVKRLIGVEIRVKKFEMEAKRLMNLDHKNIVKLLGYCHDESRGHKLVQFKGKPPQDFKGAEQLLCYEYMHNGSLREYLIGQGSHEVDWHMCYKLIKGTCEGLLYLHEGCGDRPIVHLNLNPSNILLDEHNEPRITGFDFSKLIGEKNTKSVFFQMNGPLGYLPPDFLYSKGTDLKYLTTVDIYSLGLIILEIAARQEIKGDHDIIIKTVETNWRQDSQIATLYGSLEDKFRGQVKMCIDIGLHCVKSKPEKRPTAGEIVLWLDNGSKPVLGQRPAVAGPPLRDNVTHADGHIQETEKQTPL

SEQ ID NO: 172 - protein, 518 aa, Secale cereale
MGRKRHQVDTYKVEELRQFTENYQDMLGEGVFGVVYKGMRKDGKLIAVKVLKERWVENQQNEFKRELDILKTITHPNIIELVGFCYHVGNKCNNTTSGVHQIGAALCFEYAHHGSLKPYIAGDTLDWRTRYGIIKGTCEGLKYLYHDHPSGRILHRDLKPDNILLDDDMVPKIADFGTAELYNDQTTALTNIFGAASRYATPEFRNEGLISKTCDIFSLGVIIMEIVAGPGAYDEIDDMSHQQAIELVCTKWRDTVDEIQLYQVLTCLELAKKCAHIESKKRPGIKHVLEKLNEVEKMVPEEKTANNQGMEEGDKYKQGKKGHVREEKQHETLDSTKIESHHTCIAPKAFVHEQLKKITNNFSVLLGEGSYGIVYKAIYEDVKEAAVKVLCQLPEGSDKEEEFKTQVRIRLGLKHQNIIQLVGYCYEVGPRKNRFTEKTDTLFLHAALCYEYAPNGNLAKYITDEGDGLDWHTCYKIIRGTCEGLSYLHNHPSGSVLHLGLKPENILLTSSMVPKIGD

SEQ ID NO: 173 - protein, 593 aa, Secale cereale
MDRPENIVTHLIQEEHRSRWIAHSNHNVKCFTEDEIRRFTNNYKTVLGRGGFGEVYGGVLEDKTMVAVKKFIHNVKENFAKELIVHREINHKNVVRLVGYCVDENALMVVTEYIPKGNLSNILHQGSIPIALDTRLRIAIECAEALSYMHSQMYTQVIHGDIKPANILLDEELRAKISDFGISRLVNTENTLYTLNVMGSIGYMDPLFAQNGRLTTKSDVYSFGVVLLELITRKKARTEDGKIGLVESFIQYLSKGSKRVREMFDPEIATSSDMKTIDEIAKLLGKCLRMELNKRPEMFEVAERLRKLRKAPHQVQERLALFPWGRKNKLARAKTPSLESSTSQVFDLKDLLGALTEVLGKGTVGTTYKATLDSGYELVVKWLKDVNMPKVEFELHATRIGAIQNKHIVPLLWHYHSEPDKILAYSFIPMGSLAKVLHGDGVSGPAPLDWEQRSAISLAVARGMTAIHSAGPSSCHGNIKSSNILLTGTHDACVSEHGLITLLAVSSNASGYRAPELTGDRRVSQKADVYSFGILLLEILTRKAPANSVRHMEGVNLPRWVRSVVCAEWTVEVFDVELRGREQKDGEECMVRL

SEQ ID NO: 174 - protein, 646 aa, Oryza sativa
MNSQDNNLKNFFQTNGHVVFQRVENNCSLRYFTENEIRQITRGYSILLGKGSFGKVYKGMLDGRCPVAVKRYIHGTRKEEFAKEVIVHSQINHKNVVRLLGCCTEENALMIVMEFICNGNLNDILHCSNTNGRVPFSLGKRLDIAIEVAEVLWCMHSMYNPVLHGDIKPANILVDENLSPKLSDFGIARLLCANGAQHTNNIIGSIGYVDPAFCMNGILTPKSDVYSFGVVLLEIITRKKAVDGTITLAQRFTEAVEQGKKVMHLFDEDINNTKNMNFLEDIGKLAVKCLRREVEVRPEMVEVATSLRMIRKALEEEEGNLIQQNISAPSNSIPSKNVKSSAQQFGNLKIFKQEEIKLMTKNYSMKFREEFCERLYNGVIGTTHAVIVKQVRTSSESDRMMFLKTMSILSQKYHKNIANVAGFHLGDSISECVYESCCDLSQGNDGHVCFCNRNLYDIICTREKLPLHLRLSIAVQCAEGLVHIHSLLAENPDSHSTGLLGNFRSINIFLDKNFVPKVFNSNLSTFLGLSVMQKHTASVDRPNDQRSQIYYLDGRDISGQLFNPKSDVYSFGAVLLELITWKTVRYMSSGRVHMLTKDFLDTYRIDHSAAISFGKKVYDEQGKCFIHEAIAIGVECLQLMSRRGQK

SEQ ID NO: 175 - protein, 653 aa, Oryza sativa
LYLLFTLMGDWYEQFSQSFKDAAKEMLAKTDIDPNVKCFTRKQMKRISNNYRTILGKGGFSVVYKGRLNDGRAVAVKKYNWKTQKKEFTKEVIIQSQFSHKNIVRLLGCCVEADAPMLVTEFVPNGNLSNLLHSNSSQFPVSLGTRLQIALDVAEALVYMHSSQNHPILHGDVKPSNILLGDKDVAKLCDFGISRLLCMDSDEYTGFVIGSRGYVDPVFCQTGRLSLKSDVYSFGVVLLELITKKKGIDDKKVCLAETFARISRKGNGHELFDMDVVTNENMEFLQGIGRLALECIKFEVEERPEMKEVLERLWSLKRSRDRRIREMQVMVRSEIEVLWRRCGFGRFMISKERMDDMTYYFKTVLKECASGKAYIGRFCNAQLLVIKMSISVLDQWKNIVWNELNVQSRIKHWNDAKLLGYCLDLWEGLVLVYEYGAMSLYDVLFHDARKVSPFICGLRLKIAVGAAEGLAHLHSLGIVHGNVSTVNILLDDLSVLKVISRNYPVKIAGYGTSGLPDIDKAQHTGFFMEDSLVTSHGKEHDVYCFGLVLLTLFTWKKVSLQEADTVFEQLWDIGPPHDVNSEPEKPGQQLKEAILRCRHLEEVKSLVSRCLTSEVTKRPSMVEVAKHLKNINDLHDSTACHELAIYQSRMLSG

SEQ ID NO: 176 - protein, 677 aa, Oryza sativa
MGDWYDKLSQSFRDTAKEVLAKADIDPNVRCFTRRQMKRITNNYSTTLGRGGFSVVYKGMLDDGHSVAVKQYNWRTQKKEFTKEVIIQSQCSHRNIVRLLGCCVEADAPMLVTEFVPNGNLSELLHGNIGQLPVSLETRFQIALDVAEAVVYMHYSQNHPILHGDIKPSNILLGDKYVAKLCDFGISRLLCMDNDEYTGFVIGSMGYMDPVYRETGRLSPKCDVYSFGVVLLELITRSKGIDDQNRSLARVFAHSSIDERYKLFDNEIVTNENVDFIQEMANLALDCLKSEIEDRPQMKEVLEHLYSLKRKMLEQERKIAELMEERRIAELTERRTVAFREIKAILQDIGFERLVTKEKIDSIVGNPKQVSTSEAFSGKSSVLIQRAIGKICMGHLKNIRFIVIKMSVEADEIWKEMFLYEMIKQSRIEHCNVAKLFGCCLDHVDAPVLVYKYGDIGLHDALFGNAWQQFDCPFACEIRLEIAVGAAEGLAHLHSLNVVHGDVRTANVVLDVYSKSKLEMPGITAFMAKIAGYGTQRLLSLDKAKHEIFLTENIHYKDPHFLKTGLMAKEYDVYGFGVVLVELFAQNMVQMHDVNMVLKELDGIPARCHHLKEIKKLASWCLASKVTERPAMDKVVRCLRAVLTNLQNLHDPCNCKSMYNKSAMQSEQITSAKSASS

SEQ ID NO: 177 - protein, 620 aa, Oryza sativa
MGDWYDKLSQSFRDTAKEVLAKTDIDPNVRCFPKRQMKRITNNYSTTLGRGGFSVVYKGRLDDGRSVAVKQYNWRTQKEFTKEVIIQSQCSHKNIVRLLGCCVEAAAPILVTEFVPNGNLSDLLHGNSGLLPVTLETRLQIALDVAEALVYMHCSQSYPILHGDVKPSNILLGDKGVAKLCDFGISRLLSMDSDEYTGFVIGSKGYVDPVFCQTGRLSQKCDVYSFWVVLLELFTRKKGIDDMKVCLAEIFACSSRKGDEHKLFDMDIVTNENMEFLQGIGRVALECIKFEVEERPEMRLVLEQLLSLKRSRDKSIHEMLVVRKEIEVFLRGCGFGRFILSKESVDDLICNLKIVLKECASGKAYIGKSRGTPLMAIKMSTAVTEKWKDMLGNEIAVQSRIKHMNVAKLIGYCLDHSDGTVLIYEYGAISLYDVLFGDAGKIYRPFTCDLRLKIAIGAAEGIAHLHSLGVVHGDVSINDILLDHVSSSLVKIAGYGTSGLPDIDKALDSLETGHGKKEHDVYSFGLVLLTLFTWKKVSLPHDLKSEPDKPVLLHQEAIRGRRCNHLEMIKGLASRCLTSEATKRPSMVEVAKHLNFILIFPERRKTCHDLAIYQSRMLSD

SEQ ID NO: 178 - protein, 720 aa, Oryza sativa
MGDKIDLPENILRDYIPDVDKVKWIPDNNHNITYFTEDDIKRITNNYSTKLGKGAYGEVYKGVIGDNRFVAVKKFIRVDKLDEFAKEVIVHTQVNHKNVVRLVGCCKDNNAPMIVFEYAANGNLSDLLYCGDTPISLGTRLSIVIQCAEALGCMHSMYNPIVHYDFKLSNILVDENFHAKISDFGISRILSTDNTNSDFGISRILSTDNTNLTVNVRGSIGYMDPTFAWEGRASHQKPTNMEKNVTRRFIQAPQKRKGAKELFDVDIAKESNMKILEGIWKIAKDCIKEDIDKRPEMNDVAARLRELRKTLELGGKRQNDLKKENQHERSNSNSNTVLYRRKSLGIFNWIGATNNFKKNGGHILKDIYNIRIYTNEEILNITQNFSTALSKSSSSDVYLGDIDDNTRVAVKVFTNVSESREEFVLQLIIQSQVQHQNIVKLFGCCLEMDHPISVCEYVPNGALCNYLVVEKGEETGERSLLDMNTRHFIALGVANAIACLHEKWLDTLNGSITPWDILLDGNFCSKLSKPTPIIINESTIMTTEVVPGNYMYMAPERLFFSRGFITAKADVYSFGQLLLDIVFGIRDTMFWEELVGRKSFDFVNIVYQEVYLKQRIVDCLDPCIIQAEAYDSARSMATAEHMVKTALWCMQFSADHRPSMQKVVEMLQGTIDIDEPPNPSSSNLYDSASYSSCEPVMKMSFNYRHNLPYPSSDEGEFKLL

SEQ ID NO: 179 - protein, 672 aa, Oryza sativa
MDLQKNKHNEFIEKPKWIEDNISNIKAFTKEDIKGITSNYSKRLGNGKLGKVYKGILDDNHAVVVKKYIHMDSEEEFAKEVIVHSQINHKNIVRLIGYCTEKNNLMMVMEYMSNGDLDYHLHVKNSLDSLDIRLNIAIDCADALGYMHSMCSPVLHGDVKPSNILLDDSFNAKISDFGISRLLSTDKTHTENMITCYMDPLYYQEGRLTSKSDVYSFGIVLMELITKKRATCLTQALAEGQEMTELLDPMIANESNMKVLLEIEKLVQECLAEDIDRRPDICDVAAYLRMLRKMSQQAPQENFGWHLFAETQNDFKKQSHQGTNIISSIKMVFPRMMGILNVNMAKSENKGTPLYVSGKRIFTALEIKKITGNYSRIIGKDMFTVVYSGILEDNTQVAVKTHNMFERGKWRCANELNSLSELIHKNIINLLGFCYEMDAVILVYELIERGHLCNILHGNDTKRFPLPLDLRLDIAIGLAEGLSYMHSRSKPILHGNIRTVTVLLDDKFVPKISGFGSSKIGEDGKCRIVGSEMGYMDETFVNTRVLTRKSDVYSFGVVLLELITRKRIYYNGKDNNTAINFAKVYEKEGSGRAMFDNEISADKNIPTLEDIGILAMKCFNPDIDKRPEMKEPATNFVQDVSKSMEFNTEKSLDLNGSHRQSPGMQLPVVPRR

SEQ ID NO: 180 - protein, 1338 aa, Oryza sativa
MKVTTASGHLLLVLFASIFHPAVSSISGNGTDRLALLEFKNAITHDPQKSLMSWNDSNHLCSWEGVSCSSKNPPRVTSIDLSNQNLAGNISPSLGNLTFLKHLSLATNEFTGRIPESLGHLRRLRSLYLSNNTLQGIIPSFANCSDLRVLWLDHNELTGGLPDGLPLGLEELQVSSNTLVGTIPPSLGNVTTLRMLRFAFNGIEGGIPGELAALREMEILTIGGNRLSGGFPEPIMNMSVLIRLSLETNRFSGKMPSGIGTSLPNLWRLFIGGNFFQGNLPSSLANASNLVDLDISQNNFVGVVPAFIGKLANLTWLNLEMNQLHARSKQDWDFMDSLTNCTQLQALSMAGNQLEGHLPNSVGNFSVQLQRLYLGQNQLSGSFPSGIENLPNLIVFGLDYNRFTGSVPPWLGGLITLQVLSLTNNNFTGYIPSSLSNLSHLVELYLQSNQLLGNIPSSFGKLQFLTRIDISDNSLNGSLPKEIFRIPTIAEVGFSFNNLSGELPTEVGYAKQLRSLHLSSNNLSGDIPNTLGNCENLQEVVLDQNNFGGSIPASLGKLISLKSLNLSHNILNGSIPVSLGDLELLEQIDLSFNHLSGQVPTKGIFKNSTATHMDGNLGLCGGAPELHLPECPIVPSNKSKHKLYVTLKVVIPLASTVTLAIVILVIFIWKGKRREKSISLSSSGREFPKVSYRDLARATNGFSTSNLIGRGRYSSVYQGQLFHDINAVAIKVFSLETRGAQKSFIAECNALRNVRHRNLVPILTACSSIDSSGNDFKALAYKFMPRGDLHKLLYSNPNDERSSGICYISLAQRLSIAVDLSDALAYLHHSHQGTIIHCDLKPSNILLDDNMIAHVGDFGLARFRIDSKTSFGNSNSTINGTIGYVAPECAIGGQVSTAADVYSFGVVLLEIFIRRRPTDDMFKDGLTIAKYTEINIPDKMLQIVDPQLVQELGLSQEDPVRVDETATHCLLSVLNIGLCCTKSSPSERISMQEGKKRTNSIPLPSFDTEFPKVSYSDLARATNRFSIANLIGKGRYSSVYQRQLFQDLNVVAIKVFSLETRGAQKSFIAECSTLRNVWHRNLVPILTACSSIDSSGNDFKALVYQFMPRGDLHKLLYSTRDDGDASNLNHTTLAQRINIVVDVSDALEYLHHNNQGTIIHCDLKPSNILLGDNMIAHVGDFGLARFRIHSSTSLGDSNSISSFAIKGTIGYIAPRNECSEGGQVSTASDVFSFGVVLLELFIRRRPTDDMFKDGLSIAKHVEVNFPDRILEIVDPQLQQELDLCQETPMAVKEKGVHCLRSVLNIGLCCTKPTPSERISIQEASAKLHGIKHAYLREN

SEQ ID NO: 181 - protein, 865 aa, Oryza sativa
MSLRRLCFVLPMDADEVVVVAGAAGEEQPRRRGMAASGRLASYVRRKVGRALRCGLCGAWCHHRSSGVCSFEDIAGVDAVGAGKLGGGAGGSPRIFSYSELYIGTSGFSDTEILGSGGFGRVYRAVLPSDGTTVAVKCVAGRGDRFEKSFLAELAAVARLRHRNLVRLRGWCVQDEEELLLVYDYMPNRSLDRLLFRPAAAAAPAASAPALSWDRRRRIVSGLAAALFYLHEQLDTQIIHRDVKTSNVMLDSEYNARLGDFGLARWLEHAMSGEDAPPPQLEVSPSPHSARSSSFASANYQFRLMDTSRIGGTIGYLPPESFQRRAMATAKSDVFSFGIVLLEVATGRRAVDLAYPDDQIFMLDWVRRLSDEGKLLDAGDRKLPDGSYPLFDMGRLIHLGLLCSLHDPRSRPSMKWVVENLSGSCSGDLPPLPSFLALPKYVSLTSPSDSGTTTNATDSTVTSASKLYGTAAGTTIYLTAENGHRSRGGLADNSGGSSQRSTRPLVVIPSVDTPREISYKEIVAITNNFSESQMVAELDFGTGYEGFLDNGYGGNGARRDRVHVLVKRFGMKTCPALRVRFANELRNLAKLQHRNLVQLRGWCTEHGEMLVVYDYSPGNLLSHHLLRRDGAGAAAVLPWRHRYSIVKALASAVLYLHEEWDEQVIHRNITSAAVFLDPDRNPRLGSFALAEFLSRNESHGGAGGHHVALPATSSAARGIFGYMSPEYMETGEATTMADVYSFGVVVLEVVTGEMAVDVRSPEVLLVRRAQRWKEQSRPVEAIVDRRLDGQVDRPELERLVRLGMACTQSDPAARPTMRKIVSIMDGNDEILKKFEQRKQQSKEEWETTNAAALSLVRRLHALAIH

SEQ ID NO: 182 - protein, 679 aa, Oryza sativa
MEVPESKLGDFIQGDDRAKWIADSNHNITKFTEDEIKRITDNYSTVIGKGGFGQVYKGVLDDNRVVAVKRYIFEDSMEDLAKEVIAHSQVNHKNVVRLVGYSIEQNNALMVVTEYVSKGSLHDILHQSDTPISLDTRLCIAIQCAEALGYMHSSMYTPIVHGDIKPSNILLDDNLDAKISDFGISRFLYGGKTRHTKNVKGSIDYMDPILFRDGTQSSKNDVYSFGAVLLELITRKRIKEEGKVSLITSFTEHDSEGKRMKDLFDANIASVSNMKIINQIGKLATKCLAMDMKKRPKMNIVAEHLRKLREYRNGGHDNTTLWRSFSVTQDLFEKYKQSTRNASYGSTKHPKKKKKKSFAIFKHNSGNSKLLEKLGAVRIFTKKELKKFTMDYSCLLLKDGLAEYHRGILEDNTLVTVKTPYDGDESLKNCFLMEMMILSHISHKNMVKLLGCCLEANIPILVHEYTAKGSLSDIVHHQPGYFSLPLRLKIASETSEALAHIHSSTVGGIVHGPLTPYDVLLDENFMPMVSCFLSSRSITKDKDHIVPVLRMTRCNDPVYMQTGIAKNESFVYSFGVILMVLIRGRMPKDHNFVSEFIQAYEAEDSGERMFHLSITGDQEDRMAILEEMGRMAVRCVSPEEDGRPTMAEVAERLELLRSQNFDSAVEDHDAHTYAWRKSL

SEQ ID NO: 183 - protein, 642 aa, Oryza sativa
MTMRTVHDNPNIRIFTEGDIERITNNYSTLIGKGGFGEIFRGVLDDEDDMVAVKRYIRGDLRDEFMEEVRIHAQVTHKNIVKVIGYCIGKKSLMMVTEFISNGNLEYALHNSGISIPLGTRFGIAIGCVEALSYMHSMHLSSGNLICHGDIKPTNILLDGTLIAKVADFGLSKSLSGGITRYTENVKGSIDYMDPIYLSAGRVTRKSDIYSFGVVLLELISQKRVKEKGGINLIAAFNQAYANGKGFRGLLDTEIANECNMKILEGIGKLAVECVAIDANKRPNANDVEKRLLMLWAAQHGKEENIIRRLYRRSPPEIISSSSSNKLGNARIFREGELKKVTENYSSHLATGSSYNIYKGTLEDNTLVAVKKYFDRYEAGKEEFRSRVAMVIMSPVVHKNITKLLGICLEANPPTLVYEYAARNLSDILHCKEDFPLELRLKIASKTSRVLEHLHSSRIALRHGDVMPSNILLDDGFVPKVTAFTLSTRFTEDNATRMSMVKGDGNYMDPYYRHTNLVLLKSDVYSFGVVLLELITRKQPAGDCPEKYGLVSEFARAYKMNKSGKAMFDERIATEENIPVLEEIGKLALHCINLKLSKRPTMKEVAERLKKIRRWCNGHEGYRMLIQPECTMALSRRSQFVD

SEQ ID NO: 184 - protein, 525 aa, Zea mays
MIKGICEGLHYLHENDRAPIIHLNLKPANVLLDAAMEPRITDFGLSRLIGEGNTRIVNTHTPGPIGYMAPEYRYMGEVSRKVDIFSLGILILEIVTGQDNSTKVDFIDHVCEHCMEGPQIKFMYPSLEPELHDQVELCIKIGLECVQTDRKKRPTAGDIIRKLEEGTKLGPTPSRENITTEIGKPQMFSFELLNDITESFSPGRLRGTGGFGYVYEGIPHGNEGAMAVKRLKEKIGISPKQFENEVHNLSRIEHRNIVRLIGYCDEIREILSHGKNKNDPPIREHIQERLLCYEYMPKGSLDKIIYDNLDWHTRYKIIEGICHGLHCLHEGQQDIQIAHLDLKPANILLDSDMVPKLADFGMSRLFSLEQVYILASKPMGTIGYIAPEYLDHKKVSTKADIYSFGIVVLEIVTRKQCPRSYADINAQHFIHHLRQNLTKDNYVKSMYPALEADCLQQVKLCIEIGLNCVEKEPTKRPTAREIISMFNQKKDSSRSGVSNCIVNVIEAWLSRLPWHPWPLTLLRQT

SEQ ID NO: 185 - protein, 568 aa, Zea mays
MDSEASMFDHIELMLLDESVEPSDMPLSFLTAITNNFSEDQTIGRGGFAVVYKGLLRNGLSVAVKKFYDTIELSDEMYRKEVQSMMRLKHANIVRFFGYCADTQWKMFKHDGYTIAVRRLLRFQGIEMKQFDNEVNILMELRHKNIVNLLGYCHEVRGTYVQYKGKPVFAETSEQLLCYEYLHCGSIDKYIFGKNHELDWHTRYKMIKGICEGLHYLHENDRAPIIHLNLKPANVLLDAAMEPRITDFGLSRLIGEGNTRIVNTHTPGPIGYMAPEYRYMGEVSRKVDIFSLGILILEIVTGQDNSTKVDFIDHVCEHCMEGPQIKFMYPSLEPELHDQVELCIKIGLECVQTDRKKRPTAGDIIRKLEEGTKLGPTPSRENITTEIGKPQMFSFELLNDITESFSPGRLRGTGGFGYVYEGIPHGNEGAMAVKRLKEKIGISPKQFENEVHNLSRIEHRNIVRLIGYCDEIREILSHGKNKNDPPIREHIQERLLCYEYMPKGSLDKIIYDNLDWHTRYKIIEGICHGLHCLHEGQQDIQIAHLDLKPANILLDSDMVPKLADFVAT

SEQ ID NO: 186 - protein, 504 aa, Zea mays
MDSEASMFDHIELMLLDESVEPSDMPLSFLTAITNNFSEDQTIGRGGFAVVYKGLLRNGLSVAVKKFYDTIELSDEMYRKEVQSMMRLKHANIVRFFGYCADTQWKMFKHDGRHVIAEARQRLLCFEFVPNGSLDKYISDMFHGLEWRKRYQIIRGICEGLRYLHDENVLHLDLKPSNILLDHNLVPKITDFGLSRCFDDNKTRTVTANLIGSVGYLAPEFFSGLISFKSDVYSLGVIIMEVVTGIKGYCEIEDVLESWRKRLKMPMGDALEQIRVCVEIGTMCIESNPLNRPDLRHIIELFDEMENMRLVTKTTSSLGTQGSDEHDSEETIASAITDEKREKLSVLSTLPKYLPFAFLEDITDGFSKERQLGRGGFGVVYKGILSDGYTIAVRRLLRFQGIEMKQFDNEVNILMELRHKNIVNLLGYCHEVRGTYVQYKGKPVFAETSEQLLCYEYLHCGSIDKYIFGMITKSDGINPLPAATKDVLVLFLVRASSLISLPKK

SEQ ID NO: 187 - protein, 525 aa, Zea mays; identical to SEQ ID NO: 184

SEQ ID NO: 188 - protein, 573 aa, Zea mays
MKGDSSRQNSLEDNSQILSAFPREPKLEFLKNITKDFSSERVIGHGVFGVVYKGILQNGQLVAVKKLVQTSGVHDRRFQNEAGNLQFLEHRNIVKLLGSCYQVEKKLVERNNKHFLSDVPEKFLCYEYLSNGSLDNYIYDESSGIDWTMRFKIILGICNGLHFLHEERSEAIVHLNLKPSNIMLGDDMVPKIADFGLSRLFGEEQTRTLTKNVVGWIGYIAPEYHYRGEISVKSDIFSLGVLILEIVTGLKRDLNIQDISSELLIDNVSKNWTEMSHIESKYPSLEEQHLLQVKRCIELGLNCVESDPKKRPTVGSIIGKLKEISHEASIHKFMEKKLQLITEFPREPKLHFIEVITGDFANEREIGKGSFGVVYKGVLQNGEVVAVKRLLVVAKTNLDKQYLNEVSSLIDLNHRNIVKLFGYCNEIQRKLVESHGTYVFADTEERILCYEYLPRGSLDKGYMAPEYYYRGEVSTKSDIYSLGILIIEIVTGLKVDSNTVDLSSKNLIDNVQRIWTKMPQIASKYPTLEASNLQQVKRCIDAGLNCVSEKPRERPSAGEIIKQLNGSSFPSRN

SEQ ID NO: 189 - protein, 881 aa, Zea mays
MQTAVVVVAALLLHLSALPRLGLATATADTNQTSGNDTSCTSARCGNLSVTYPFSLAGVQPIYCGFPSVLPDDMRRRQPHLPQQDVQGSPLQRPPHILRQQPTVALSCTASLILACLGWMMYRQKRKEEQITSASNQKYKSYESNIKEILQGYGSLVPKRYKYSELKKITGSFKDKLGEGSYGTVFKGQLEDGRKVAVKLLKGSKGNGEEFVNEVVSIRRTSHVNIVSLLGFCVHGHKRAIVYEYMANGSLEKYIQSEETRMAIGWEKLREIAAGIARGLEYLHRGCSTQIIHFDIKPNNILLDEDFSPKIADFGLAKLCHLKDSALSMAEARGTIGFIAPEVFSRGFGVVSTKSDVYSYGMMLLEMVGGRKNLTESTENSSQEYFPNWVHDRLVKDLQSHEVTCKTEEIAKQMTLVGLCSTTTTTGGAPNTAAPCAPAWCGDLAISYPFWLAGTHPPKCGYDQGFEVTCDKAKAYLKNSTCTYQIQSIFYAMNLLRVAIVGLLSLDDGTCNVDKFVNASFVPSPAFEIEPQQNQELFFVYDCNLRAPQLPRSWTPLRCGNNGSFTWLSGQYRPEDSSMALPGNCNVAMIPVVAYEGATAADYQRLVEGGFFLSYYLTDTEDHYYYGQCQACSYRAGHGQCRTIVSDDGFQCYCSDGVYSTTACGTKRANWKTTIVDKDFCPKIADFGLAKLCHSKDSKLSSVTDARGTIGFIAPEVHSRTFGVVSTKSDVYSYGMMLLEMVGGRKNVKSVVENSSEKYFPHWIHDHFAQEGGSSQGYGGGVTGEVEETARKMTLIGLWCIQILPVHRPTITKVLEMFERDLHKRLDMPPKQNFSQILEDSAVYNLNTESMMSPSSSSMETQGSSEGLKAEEMKCVNSNVI

SEQ ID NO: 190 - protein, 881 aa, Zea mays
MSSSLSLRRLCFVLPMDADEAVPPASHPEGPARRSPARVASLELETAGSYARTTAVRLLSCLRRWRPRPCCRGAGRWHDDSSEKAAAFEDIAGVVDDVAGRKQLAGGGPRIFSYSELYIGTRGFSDAEVLGSGGFGRVYRAVLPSDGTTVAVKCVAASSAGARSDKSFLAELAAVARLRHRNLVRLRGWCVRAGEELMLVYDYMPNRSLDRLLFAPPKAAAPASAPRLSWDRRRRIVAGLAAALFYLHEQLDTQIIHRDVKTSNVMLDSEYNARLGDFGLARWLEHAVGADDALNPLHPEASPPSLRLSSSSASAAVSANYQFRLMDTSRIGGTIGYLPPESFHRRAAGGTAKSDVFSFGIVLLEVATGRRAVDLAYPDDQIFMLDWVRRLSDEGKLLNAADAKLPDGASALFDVARLMHLGLLCSLHDPRARPTMRWVVENLSDGCSAGDLPRLPSFVALPKYISLTSSSASDSGATTVTTDRSTAATSLTNSNPVYDTAAADTIYHTAEDGRTTGSRSASADSGRRSSSRLAPVAIPHVDTPREIPYKEIVAITNDFSESQVVAELDFGTGYEGFLDTGHGRVHVLVKRLGMKTCPALRVRFARELCNVAKLRHRNLVQLRGWCTDHGEMLVVYDYSPGSLLSHHLLRRRDCGAVLPWRQRYSIVRALASAVLYLHEEWDEQVIHRSITSSAVFLDPDMNPRLGSFALAEFLSRNERHGGGHHVVVTASSARGIFGYMSPEYMDTGEATTMADVYSFGVVVLEVVTGTMAVDGRLPEVLLVRKVQLLEQQDRPVEALADRRLDGKFDRRELVRLARLGMACTRSDPAARPSMRKIASILDGNEDVLDKLEQRKESTEDWQRRNATNLALVRRFQALGIH

SEQ ID NO: 191 - protein, 690 aa, Zea mays
MKFEFPEDEIASITSNYSTLIGKGGFGEVYRGVLDADDDLVAVKRYIRQDLRDEFMDEVNIHSVMNHNNVVKLIGYCIGESTLMLVTEYISNGNLDDILHRSDASIPLDVRLGIAIGCAEALSYMHSMDSQSDNHIYHGDIKPANILLDNNLTTKVSDFGLSRFLFSGTTQFTTTLKGSMGYMDPVYFHEGCLSPRSDVYSFGIVLLELLTRKRAKYGDVNLIPTFNKACAKGKGLRELFDAAIAEKDNVKILKESWKLASQCLSLNIHTRPQMNEVAKRLRMLKKELKTSPQSILATHSMWAKQYRQAGSSSPSFKKKLSFFKGNASSYSKVISELGDNVRVFTKEEINEVTHNYSNLLSGGTSATEVYKGTLEDNTMVAVHRLVYEGSEEAFINGGMVVSKIAHRNIVRVLGCCLEPQTTAFLYEYVAKGSILDILCSQEDFPLDLRMRIAIKTAEALQYLHSSETGVTGHGSVSASTILLDNNLVPKLTEFSRSCTLFKESETTSVVGAGVMITGSLLEKALNDDPSRYGSVLMNLESDVYRFGGVLMALVSRDGDGDGGHDGLLARFTRAYETEETGRALFDRDVITAEEDVALLDELGRLALKCSVLDADRIAVRPTMKEVADELRTMRRSWKERSRSTEAPAAYVDVAAAGAAVVPAEAARLPNLMRHMFGYRRISVGDPIRVC

SEQ ID NO: 192 - protein, 851 aa, Arabidopsis thaliana
MAPMAMDHLCFVLPTESGELKPPVMVEETTEEEEEKKSRDCGRQVVSLIGDLFRRLHGSKLVKSLNLCSINESKDSISMEINKSFTDMEGVQLSSKVGCENPRIFGYSELYIGTNGFSDELILGSGGFGRVYKALLPSDGTTVAVKCLAEKKGEQFEKTFAAELVAVAQLRHRNLVKLRGWCLHEDELLLVYDYMPNRSLDRVLFRRPEVNSDFKPLDWDRRGKIVKGLAAALFYLHEQLETQIIHRDVKTSNVMLDSEFNAKLGDFGLARWLEHKIDETEHDSSYDSVSSFRNHQFRVADSTRIGGTIGYLPPESFRKKTVATAKTDVFSFGVVVLEVVSGRRAVDLSFSEDKIILLDWVRRLSDNRKLLDAGDSRLAKGSYDLSDMKRMIHLALLCSLNNPTHRPNMKWVIGALSGEFSGNLPALPSFKSHPLYIPLSSLKSTSTSATTTTTRTTMTTTTSTTSFNASSESTPSSNYVTALEDSIYQTAETGENPYFNYNSRRVMSSKSFVLDTPREISYNDLVLATDNFSDARRVAEVDFGTAYYGLLNGDQHIVVKRLGMTKCPALVTRFSTELLNLGRLRHRNLVMLRGWCTEHGEMLVVYDYSANRKLSHLLFHNHIPGNSVLRWKSRYNVIKSLACAVRYLHEEWDEQVIHRNITSSTIFLDRDMNPRLCGFALAEFLSRNDKAHQAAKKKGSAQGIFGYMAPEYMESGEATTMADVYSFGVVVLEMVTGQPAVDYKRKKEDALMVLRIREVVGNRKKLLEEIADIHLDDEYENRELARLLRLGLVCTRTDPKLRPSISQVVSILDGSERFFEEEGGKEGDVSRKQMYDSSMLMIRQMQALGIH

SEQ ID NO: 193 - protein, 876 aa, Physcomitrella patens
MAFPTSSDPDSGWEMVDEPIDQVRQALAIIANVRKISETVWVNKRQCKRVADRYFAISELLNNMSCDKYSTVGKAFGGGSSSSNKDYPAFDDLLTVLLKGQSLVSYYEDPKGISIVISRTDNREAFKEIHEELDTMKAQFDFEGLTEVFESTSVQTRINILTADAEADKKEMQEIFTNIQELSRTTDMGMDAEKIAHVVLEKNEHAKGSDELPSYLKINLAAIEINSPVREYRRQSTRDPKEMDGWVLVFSGKWLGCDFAVKVFKAGAVGGAMWNKQQLLKEVGCLEGLRHPHITRLVGFGQDNEKSIFLMELMDGDLRDFMRQKLQFAPTPNSRPFNRSEELDIITQIAKGMYYMHQQGYVHGDLKCSNLLVKNCDQYLEVKISDLRGSQKLDKEWDPVAFKQASLTRRPRWTAPEAIAEYGGLQPSKESLKKSDVYSFGMTCYEIVTGKYPFDGIKDDHLLKQIEEGFRPELPEDLDKSLKGLITTCWDKEPRIRPSFENICHLLGVTRSKKPPVTITSPGKDVLGVFRGISIVREAVFGLIGRKRKIQTPEQSSTWEAQEEDSTHFRRSPSELMVPEYLRIPPGELKKVRCIGHGNSAKVYEATWLGCTFAVKRFKTGSSHRDLQHEVDFLINLSRHPCIVQMVGLSVDSKDKCSIVMEYMKGNLHELIYSRMQKKISEATGQKIPACDVVPFDIHEAVFIITRIALGMAYLHFKGVMHRDLKPVNVLAQEHAGSLDVKIVDFGISHLELPSDSSQARGPYMNAGTGFWRAPEILPGCDETRGKLDLKATDVYSFAITSYEILTGITPFLDIKRKDYHRVREGLRPKLPADLNSELKELIEQCWHTNPLKRPAFPEICERLERIQRMLPRSTS

SEQ ID NO: 194 - protein, 1250 aa, Solanum tuberosum
MTYTSFICFLLISYLVQANCRNDSTCPKSFSCGNLTDLSFPFSLSTQPDCGIVPISGCDAKPYPRIQLLPGGDSYYALGNPFNYTVFLGDPKLHAKLRQHKCQAFNKKFSLPNSSSISFILLLLNFVNFFKCNITSNSTPNVTHTNDHFAGYKRYNGCTGFSIYYKLRLGDHEDAHAGNLPANCSLNRLPIGSISDEGGLFNMLSAGFLVQWKLSADCYKCHYGGGAVLFTVGLLVLLFYFREKILWYKYIRFWESNAEDHQNIEAFLKNYGSCYPKRYNYLEVKRITSGFKNKLGQGGYGSVYKGCLHNGSHVAVKVLKKLKGSGEEFINEAASISKTSHVNVVSLVGFCFEGCKRALVYEFMPNRSLEKFIYEERSDSVHQLAWPILYKIALGIARGLEYLHRGCTTRILHFDIKPHKILLDEDFCPKISDFGLAKLCMKKESIVSMFSARGTIGYIAPEIVCRNLGGVSHKSDVYSYGMRVLEMVGGRKNVDVGVDRTSEICFPHWLYQRIELDEELQLIGIMNEEEKECARKMVMVSLWCIQTDPSNRPSMSKIVEMLEGKLDSLQMPPKPYPYSPSRTEVRFLMCLDVLECKKIYLVQAKGRNDSTYPNSFSCGNLTDLSFLFSLSTQPDCGIMFLSGCDAKPFPRIQLLPGGDSYYALVNPSNYTFGLGDPKLHVKLRQHNCQAFNKNLSLPDSPSISCFEIIKVNFLNFFKCNSNSTSSSTPNITHKMKDHFAGYRMYNGCKGFSIYYKIQLYVEEDILARNLPANSSLISLPVDLISDHGGLFNMLRAGFFVEWKISEDCYQCHYGGGQCQTDINNKFHCTYPNNPHEQDAKTARRKFGLTLGVVFGGLGLVMICLAVYFIWCCKRRKFNPPHFLSTRKLSCTFKNDVERGSIYFGIPVFSYSELEEATNDFNSSQILGDGGFGTVYYGKLKDGREVAVKRLYEHNCKRMQQFVNEIDILTRLRHNNLVTLYGRTSRRSREPLLVYEFIPNGTLADHLHGDRVKDGSLTWLVRMNIAIETAGALAYLHASDVIHCDVKTNNILLDHNFNVKVADFGISRLFPNVVTHISTAPRGTPGYIDPKYYECYHLTSKSDVYSFGVVLVEHISSMPAVDMTRHSQEINLANFAINKIVKCAFNELIDPSLGFDSDTKILEMTTSVAELAFLCLQTDRDMRPTMVEVLDILNEIQISEFDNEKRADSNLNGNEAKIVTAPSFTESEDMFKLKQVKSLPSSNFVTDKWVS

SEQ ID NO: 195 - protein, 928 aa, Brassica napus
MGCISSKNVSYLGDQSASPVQDRENTPGPDFSSTNQHHRVFVDHSLEASQNINRRSRKSKRLGGSDSRVCKSLLSGLSHRNIEAEHAAAGWPSWLCEVASEAVHGWVPLKAEAFQKLEKIGQGTYSSVFRAREVETGKMVALKKVKFDNLQPESIRFMAREILILRKLNHPNIMKLEGIITSRASSSIYLVFEYMEHDLAGLSSNPDIRFTESQIKCYMQQLLWGLEHCHMRGVIHRDIKASNILVNNKGVLKLGDFGLANVVTAKNKHQLTSRVVTLWYRAPELLMGSTSYGVSIDLWSVGCVFAEILMGKPILKGRTEIEQLHKIYKLCGSPPDSFWKKTRLPHATSFRPQHTYEATLRERCKELSTTGVLLLETLLSMEAYKRGTASSALNSEIGQGTYSSVFRAREVETGKMVALKKVKFDNLQPESIRFMAREILILRKLNHPNIMKLEGIITSRASSSIYLVFEYMEHDLAGLSSNPDIRFTESQIKCYMQQLLLGLEHCHMRGVIHRDIKASNILVNNKGVLKLGDFGLANVVTAKNKHQLTSRVVTLWYRAPELLMGSTSYGVSIDLWSVGCVFAEILMGKPILKGRTEIEQLHKIYKLCGSPPDSFWKKTRLPHATSFRPQHTYEATLRERCKELSTTGVLLLETLLSMEAYKRGTASAALNSEYFLTRPYACDPSSLPKYPPNKEMDAKNRDDMRRKRANLKLRESGVGRKHKRPHREEQDPKSYAKLPIRQDTFEDKNITNEEGPRATTTTHGNYYKLSDLPMTTGPASGFSWAVKRRKDPDNISTLTYYQPSSRSQLSETSAAFAKNTFGLNLKPENESVYEIQGDNDDQIMEELPSEDKLSRTGKRHGSLDGSGLDFSQRGEDSPLKKNLEHLQFGKQSISGPLIFKSGKIDEILQRNESNIRQAVRKSHIKLGK

SEQ ID NO: 196 - protein, 820 aa, Brassica napus
MIDAPKFIGGNNHNHNNNNYYEDYQKLEGSNMSIDSLQTTVVGVSVATSRDNSSVGSNDSKTHILGHPGLKPVRQHYTGSTENSVYRPGNHHELNDDALQQALMDSRYPVEGLADFDEWTIDLRKLHMGPAFAQGAFGKLYRGTYNGDDVAIKILERPENDPEKAQLMGQQFQQEVMMLATLKHANIVRFIGACRRSMVWCIVTEYAKGGSLRQFLTKRQNRAVPLKLAVKQALDVATGMAYVHGLGYIHRDLKSDNLLISADRSIKIADFGVARIEVKTEGMTPETGTYRWMAPEMIQHRPYTQKVDVYSFGIVLWELLTGMVPFQNMTAVQAAFAVVNRGVRPSIPDDCLPVLRNILTRCWDADPEVRPPFTEIVMMLERAEAEVMNNVRKARFSKWETATKINASSSSKMLEGAKFNVLAVGNHNNNDYAFTQEFYQKLNEGSNMSMQTSNAGGSVSMSVDNSSVGSSDALIGHPGLKPLRSSSVYSLSVGQSVFRPGRVTHALNDDALAQALMDSRYPTQGLASYEEWTIDLRKLHMGPPFAQGAFGKLYKGTYNGEDVAVKILERPENSPEKAQFMEQQFQQEVSMLANLKHQNIVRFIGACRKPMVWCIVTEYAKGGSVRQFLTKRQNRAVPLKLAVKQALDVARGMAYVHGRNFIHRDLKSDNLLISADKSIKIADFGVARIEVQTEGMTPETGTYRWMAPEMIQHRAYNQKVDVYSFGIVLWELITGLLPFQNMTAVQAAFAVVNRGVRPTVPSDCLPVLNEIMTRCWDANPEVRPCFLEVVSLLEAAETEIMTTARKARFRCCMSQPMTID

SEQ ID NO: 197 - protein, 859 aa, Brassica napus
MANSTKSYKDHEPDYETSTAGPDSSRRTSWLSSSFTASPSCSSSISHLSNHHDLNTYNHQSKPHKANQIAWEAMARLRRRCGRAVGLEHFRLLKRLGSGDIGSVYLCQIRGSPEVAFYAMKVVDKEAVAVKKKLGRAEMEKKILGMLDHPFCPTLYAAFEASHYSFLVMEYCSGGDLYTARLRQQSKRFGISSTRFYAAETLVALEYLHMMGIVYRDLKPENVLIRGDGHVMLSDFDLSFKCNVVPQLLNHNDYDRQVHDYDDDDDDFSICSTPSCTTTPLHPVISCFSPASSRRRRRKNVITTTIHETAECTSGSVKSNDVSRTFSRQPSSCSRVSSGLRDLSGGCPSIFAEPINARSKSFVGTHEYLAPEVISAKQMFNFASSSISHPSNHHDLNTYNHQSKPHKANQIAWEAMARLRRRCGRAVGLEHFRLLKRLGSGDIGSVYLCQIRGSPEVAFYAMKVVDKEAVAVKKKLGRAEMEKKILGMLDHPFCPTLYAAFEASHYSFLVMEYCSGGDLYTARLRQQSKRFGISSTRFYAAETLVALEYLHMMGIVYRDLKPENVLIRGDGHVMLSDFDLSFKCNVVPQLLNHNDYDRQVHDDDDDDDFSICSTPSCTTTPLHPVISCFSPASSRRRRRKNVITTTIHETAECTSGSVKSNDVSRTFSRQPSSCSRVSSGLRDLSGGCPSIFAEPINARSKSFVGTHEYLAPEVISGQGHGSAVDWWTFGVFMYEMIFGTTPFKGDNNEKTLVNILKAPLTFPKVIVNSQKEYDNMVSAQDLITKLLVKNPKKRLGSLKGSIEIKRHDFFEGVNWALIRSIKPPWSDNRSVNYFLPPRFMMTRKERDEPYHVSNHFDYF

SEQ ID NO: 198 - protein, 852 aa, Brassica napus
MAPMSVDRLCFVLPAESGELKPSVESPAMVEETKEEEKKSRDCGRQVVSLVGDLFRRLHSSKLVKSLNLCISERDKDSNFLEINDKPFTDMEGVQLSGKIGAENPRIFGYSELYIGSNGFSDELILGSGGFGRVYKAVLPSDGTTVAVKCLAEKKGEQFEKTFAAELVAVAQLRHRNLVKLRGWCLNDGELLLVYDYMPNRSLDRVLFRSPEMNSKFKPLDWDRRGKIVKGLAAALFYLHEQLETQIIHRDVKTSNVMLDSEFNARLGDFGLARWLEHAVEEAEFDTSYDSVPSFRNHQFRVADSTRIGGTIGYLPPESFRKKTVATAKTDVFSFGVVLLEVVSGRRAVDLSFSEDKIVLLDWVRRLSDDQKLLAAGDSRLPKGSYVVSDMKRMIHLALLCSLNNPHLRPSMKWVIGALSGEFSGNLPALPSFKSHPLYIPLSSLKSSSTSGTTTTTATTTIPTTSTTSLNASSESTPSSNYVTALEDSIYQTAETGENRYFTNNSRRVMSSKSFVLDTPREISYNDIVLATDNFSDARRVAEVDFGTAYYGLLNRDQQIVVKRLGMTKCPALVTRFSTELLNLGRLRHRHLVMLRGWCTEHGEMLVVYDYSANRKLSHLLFHSQGTTVLRWKTRYNVIKSLACAVRYLHEEWDEQVVHRNITSSTIFLDRDMNPRLCGFALAEFLSRNDQAHQAAKKKGSAQGIFGYMAPEYMESGEATTAADVYSFGMVILEMVTGQPAVDYTRKKEDALLVLRIRDLVGNKKKPLEEIADVHLDDEYERGEMARVLRLGLVCTRTDPKLRPSISQVVCTLDGSERFFKEEGGKEGDVSRKQMYDSSILMVRQMQALGIH

SEQ ID NO: 199 - protein, 629 aa, Brassica napus
MKKFFCCHKGESSSGAVEAEEQTQPLQPVQLQPSSSQPVQDPQASSRSVKDENEAIFDENLFDNNEGLNLAWRNLWKSYEDAKAATHDPYPGPKIKWSEIFQGTLNFRNINYLGRGNFGEVYRCDIPRLDKTGAAKVQNNPSEEAHAEFLAEITTLHAANHPNVITLLGKCFHQDHRVIVYEFMHRGSLDHHLFPNTRLLRGRGRGLLQVYKVLSWTMRLRIAVGVAKALVYLHEELKMVHRDVKVSNVLLDKKFVPKLTDFGLASCIVEDENGVEKRSEITLIKGTPGCTAPETEELETPRVSPPRLPYFTIRWEEILEGTQNLDNTNLLGEGNFGQVYRCNLPRLNQVGAAKIQKVENEEAKTEFEAEITTLHRANHPNVINLLGQCVTDEDRVIVYQFMPRGSLDHHLYADTRPAPGLQQQRNAVLSWERRMSIALGVAEALIYLHEELKTVHRDLKVANVLLDEDFVPKLTDFGLATRMVHDANGIEKQSQIDPIKGTMGCIAPETEGSGLVSSKSDVYSYGVFLLTLFTGRKAFDRARPAASRKINGWLMSVWTREDYLPIVLDVALGNTYSAEGIKRLFQAARMCMDPNVLARPTMRFVETMVRQAAAYDVATLPPVLRRDLV

SEQ ID NO: 200 - protein, 800 aa, Populus trichocarpa
MKLNCFCIILPEDFEEIKPFDQPQIRPPVHDDVKKRQHCGCGRQILHVLGDSLRRLHESKWIGCFQDDKPSKQQSGPFHDLEGIQISEKVGGDNPRIFSYAELYIGSKGFCENEVLGSGGFGKVYRAVLPSDGTVVAVKCLAERGEQFEKTFEAELVAVAQLRHRNLVRLRGWCAHEDQLFLVYDYMPNRSLDRVLFRRPENLKAEPLAWERRRKIVSGLAAALHYLHEQLETQIIHRDVKTSNVMLDSHYNARLGDFGLARWLEHELEYQIRTPSMKNHQFRLAESTRIGGTIGYLSPESFQKRSVATAKSDVFSFGIVVLEVASRRRAVDLTYPDDRIILLDWIRGLSDEGKLLQAADNRLPDGSFGLSDIERLIHLGLLCTLHNPQLRPNMKWVVEALSGNILGKLPPLPSFRSHPRYIAISPATTEETMYATAEFESSNKLSSSKSNNRSHRQNAFFMVETPREISYKEIISATNNFSDSQRVAEVDFGTAYYGILEDGHQVLVKRLGMTQCPAIRVRFSTELLNLGRLRHRNLIQLRGWCTEHGEMLVVYDYSASRLMSHLLFHHDNRIGHSILHWRHRYNIIKSLAAAILYLHEEWDEQVIHRNITTSSIILDPDMNPRLGNFALAEFLARNDHAHKAAAKENKSVRGIFGYMSPEYMESGEATPMADVYSYGVVVLEVVSGQMAVDFRRPEVLLVLRVHEFETQKRPMEDLADIRLNREYDHEELIRIVKLGIACTRSNPELRPSIRQIVRILDGNDQWFMEGGKRKESREEWRQNNASSLSLIRRIQALGIK

SEQ ID NO: 201 - protein, 781 aa, Populus trichocarpa
MQLNRLCIILPADLEEIKPFEDPKIPQPMQDGVRKDRHRGCGSQILHFLGDSLRRLQDSKWIGCFLHDKPSKQQPQPGLFYDLEGIQLSEKVGGANPRIFSYAELYIGSKGFCEDEVLGSGGYGKVYRAVLPSDGTVVAVKCLAERGEQFEKTFAAELVAVAHLRHRNLVRLRGWCVHEEQLLLVYDYMPNRSLDRVLFRRPENLKAAPLSWERRRKIVGGLAAALHYLHENLETQIIHRDVKTSNVMLDSHYNARLGDFGLARWLEHELEYQIRTPSMKNHQFHLTESTKIGGTIGYLPPESFQKRSVAVDLAYPDDQIIVLLDWIRVLSGEGKLLQAGDNRLSDGSFGLSDMERLIHLGLLCTLHNPQLRPNMKWVVEALSGNILGKLPPLPSFQSHPRYIAISSATMEETIYETAEFENINKLSSSKSNNRSHRQNALFMVETPREISYKEIISATNNFSDSQRVAEVDFGTAYYGILEDGHQVLVKRLGMTQCPAIRVRFSTELLNLGRLRHRNLIQLRGWCTELGEMLVVYDYSASRHMSHLLFHHDNRIGHSILLWRHRYNIIKSLASAVLYLHEEWDEQVIHRNITNSSIILDPDMNPRLGNFALAEFLARNDHAHKADAKENNSVRGIFGYMSPEYIEHGEATPMADVYSYGVVVLEVVSGQMAVDFRRPEVLLIRRVHEFEAQKRPLEDLADIRLNGEYDLEELIRVVKLGIACTRSNPELRPTMRQIVRILDGNDQWFTERGQNTESREEWRQKNACSMSMIRRVQALGIQ

SEQ ID NO: 202 - protein, 371 aa, Sorghum bicolor
MTGSAWDIVQSFAPREQGSELGERVDTRCNSDTEEENEVEDGVAAVEGELKELRIGETFEGFTGTSSLSTTNDDDASSTTTEAMFIISPNGKFKRKIKSWMRGALLGSGSFGMVYEGISDEGAFFAVKEVSLLDQGSNAQQSIVALEQEIALLSQFEHENIVQYYGTDKEESKLYIFIELVTQGSLSSLYQKYKLRESQVSAYTRQILNGLVYLHERNVVHRDIKCANILVHANGSVKLADFGLAKEMSKINMLRSCKGSVYWMAPEVINPKKMYGPSADIWSLGCTVLEMLTRQIPFPNVEWTNAFFMIGRGEQPTIPNYLSKEAQDFIGQCVRVDPESRPSASQLLEHPFVNRPLRASFESASPPAIRL

SEQ ID NO: 203 - protein, 653 aa, Sorghum bicolor
MKGDSSRQSSLKDNSQVSSAFPREPKLEFLKSITKDFSSEREVGHGAFGVVYKGILQSGQLVAVKKLVRKSGVHDRRFQNEADNLQTLEHRNIVKLLGSCYQVEKKLVERNGRHFLSDVPEKFLCYEYLSNGSLDKYIYDQSSEFDWPMRFKIILGICNGLHFLHEERSEAIVHLNLKPSNIILGDDMVPKIADFGLSRLFGEEQTRILTQNVVGWIGYIAPEYHYRGEISVKSDIFSLGVLILEIVTGLKRDLNIQDISSKLLIDNVSKNWTKMSHIESKYPSLEEQHMLQVKRCIELGLNCVETDPRKRPTVGSIICKLKENSHEASICKLMEKKLQLIAEFPREPKLHFVEEITGNFANEREIGKGSFGVVYKGMLPNGEVVAVKKLLVVPQINLDKHFKNEVFSLIDLNHRNIVKLIGYCYEIHKKLVESHGRYVFADTQERILCYEYLPRGSLDKYLYGAFHELNWSISFKIIQGICQGLQFLHELQRPIIHMDLKPGNILLDDNLMPKIADFGLSRLFGEEQTRTLTSNVVGSRGYMAPEYYYRGEVSAKSDIYSLGILIIEIVTGLKVNPNTEDLSSKNLIDNVQKTWTKMPQIVSKYPTLEASSLQQVKRCIDIGLNCVSENPKERPSIGKIMEQLNGNGFPSSS

SEQ ID NO: 204 - protein, 669 aa, Sorghum bicolor
MDLPEKKLTDFIKGSEKAKWIPVNNHNVNNFTEDEIKRITNNYSTPIGQGGFGQVYRGSLDDGTTVAVKKYICQNVKDGFAKELIVHCQINHKNVVRLLGYCSEDDALMIVTEYVPGGNLKDLLHGSDAPISLDARLCIAIECADALGYMHSSMYQPMIHGDIKPDNILLDNNLGAKLSDFGLSRLLSMHQSQYTKNVIGSRGYMDPEYLETGLLDPKSDVYSFGIVLLELITRAKASENGFGTRLKRNFTDALGKGKQEARKMFDNKIANERDIEILDEIGNLAAQCFTKDIMERPEMKEVLVSLHMLRRSLRSGKAQEKIGQHQSSGTQAITQKVDNHGSSIPRSSSNSSVTYKFSNLDIFNRKSRMSKSFGGSILEAVGITIFTLKELERITRGYSHCISKDHTGFVYKGCIKNQDVAVKRLLLFWDITFEKNGFVDTMSFAFKVRHKNIISLVGCCLEMERPLLVYEFPPSKSLHEVLHCYNGTLSLDLRLRIAIGSAEALAYLCSFQKFHGNVTSTCIMLDHDLLPKVDIICGPLISHSIGLKFDTILAYLDPVYLKTGCLTSKTDVYSFGIVLLELITRKQPRHSPLIEYIGACGDENGSWIAMVDAEIIVVEGNLLILEEMGKLAVQCFREDADERPEMVEVVRRLENLRYRLQDATALSCR

SEQ ID NO: 205 - protein, 645 aa, Sorghum bicolor
MELIQGADRSKWMVTSNHSIKCFTTYEVERMTRNYITTLGRGGFGEVYEGVLEDQSKVAVKRFINNEKVNFAKELAVHREINHRNVVRLIGYCLDENALMMITEYITNGNLSDVLHQDNSPIPLDVRLRIAIECAEALAYMHSHMYTRVIHGDIKPSNILLDDNFHAKLSDFGISRLVNTDKVLYTENVIGSIGYMDPLFAQDGLLTSKSDVYSFGVVLLELIARKKATTVMDNVNIVRAFTNALARGVRGAREMFDGEIASKNSMKIVEGFAKIAGECLAMERNKRPEMIDVVERLRVLKKTSHQDLGERAGLFSWARKSKPVPAAGVTTVPAKILVLPAHLCRQFSFAEMKAATNNFHWRLIVGEGAFGRVYRGKIDGGKTKVAIKRHSPNSRQGEHEFRTEIEMSSKVRHCNVAQLIGYCDEMGEMILVYEYMPRGCLRNHLYRTKQPPLTWNRRLEICIGAARGLHCLHASQVIYRNLRTEDILLDHAWVAKLTDLALCKTAGPSMDEITRVIGSGCLLDHEYVTTGRLTEKLDVYSFGGVLLQVLCARPILDISLLNEEGSTLVDWALHCKQECRLDQIVDPYLKGSIDQSSLETFVGIAEKCLASEGVRRPSMGDVLLDLELALRQQGTTTHGLSPVVL

SEQ ID NO: 206 - protein, 703 aa, Sorghum bicolor
MDLPENELRGYIEDNGKPMWTAHNNHNIRYFKEEDIRMITNNYETLLGKGAFGEVYKGVLDDNISVAVKRYIHNVKENFAKEMIVHCQINHRNVVRLIGCCISENALMMVTEYISKGNLSDILHCSEISISLETRLDIAIGCAEALSYMHSEMYGQVIHGDIKPDNILLDESLNAKISDFGLSKLLSTDNTLYTTHVLGSIGYMDPLFAQSGRLTSKSDVYSFGVVLLELITRRKAVVDGKISLIENFTQALVKRKKIRDLYDVKVTNENNLRILDGIGKLATKCLAMDLEKRPEMKDVAERLRMIRKAQYQSQEKVLLFGWVRRSKQPPQNMVPADKHFHQNQVLKAEVQAQKESEVDRDVYDVTVVSEGSERLYSFGSSQGIELQKLLKASAEVLWKDKYATTYKAVLDDGFTLTIKRLKSVDLPDVPEAVFKERIAAIGTIEHELVVPLRQYYYSKDERLLVYDYFPNGSLASNLHGKNVAPVGWETRSAIALSVARAVAYIHSINAATASHGNLNSFNILLTGSYEARVSEHGLKTLVSAPTLVIDNNITQKDDVYSFGVILLEMLTGKSPILTDEPDLLDWILSIPREHWVAQAFDKKLLTENTVVEELVQFLKLAIHCCDKNLTLRPAMSDVTQQIEGIKYFYNWGYTSTKTMFRAGPIFLQGPLYQESSLQVVSEMAQDSLEEIDFWTQLPACRIC

SEQ ID NO: 207 - protein, 630 aa, Sorghum bicolor
MHSNRNIKSFTEGEVRRITDNYRTIIGRGAFGEVYKGVLDDTSMVAVKRLIHNVKENFDKELAVHREINHKNVVRLIGYCVGENALMMVTEYVPNGNLTAILHRDNTPIPLDIRLRIATQCAEALACMHSYKHTQVIHGDIKPDNILLDYDLNAKVSDFGISRLVNTDMTLYTGNVVGSIGYIDPLFTKDGCVTAKSDVYSFGVVLLELLTRKKATPTNGQVSVVAAFSEALESGRIREARKFLDSELDPSRNKNILDELGKLAAECLKMKRDKRPEMKHVAERLSKSMKASLEGKLRKHLCRRFSYAEMVAATRNFDESLLLGQGGVGRFYRGVIDGGATMVAVERSWHGYECNEYGDLFRSFVERRSKLNHINIVPLIGYCDERGERILVYTYIDHGNLHEHLFQTQNPLTWKQRLEICIGVARGLHYLQTGAKHQGPIWFAPGRSCLNLPGLQVSCLTEFEANTPQLIHHNLRVNILLDKEELVPKILANKTADPGLDELLGCGTSNSMGNHDFIPGDIADWLTEKLGVYSFGAVLLEVLCARPHFDLRDPEEKVNLQVWARRCKRDFNWIDPYLKGKINPQCYNRFLEIVDKCLARRCFDRPSLQDVVLDLESALQLQVSAEVSRS

SEQ ID NO: 208 - protein, 682 aa, Sorghum bicolor
MGSMSQKIKIFTEDEITSITSNYSTLIGKGGFGEVYRGVLDADNDLVAVKRYIRQDLRDEFMEEVNIHSMMNHNNVVKLIGYCVGESTLMLVTEYISNGNLDDILHRSEAPIPLDVRLGIAIGCAEALSYMHSMDSPSHNHIYHGDIKPANILLDDNLTTKVSDFGLSRFLFGGTTQFTTTLKGSMGYMDPVYFHEGCLTPRSDVYSFGIVLLELITRKRAKYGDVNLIPTFNKACAKGKGLKELFDEAIAEKDNLKVLKELWKLAAECLSLNIHTRPQMSEVAKRLCMLKKDLKSTPQSILATHSIWFKPYTQSSRPPSFKKKLSFFRGSTSYSKILSELCNVRTFTKEEINEVTHNYSNLLSGGTSSSTEVYKGTLEDNTMVAVHKLIYEDSEEAFINGGMVVSKIAHKNIVKILGCCLEAQTIAFLYEYIAKGSISDILGSQEDFPLDLRMRIAIKTAEALQYLHSSETGLIGHGSVSASTVLLDNNFVPKLTEFSRACMLFKKSETTAGVISSSLLEKALNNDPSRYGSVLMNLESDVYKFGGVLMALISRDKDSNHDDLLAKFTRAYETEKTGKALFDKDITAEEDIILLEELGRLALKCTILNADKIFMRPTMKEVADELRRIRRSWKEHWTSDAATHVTTETTTDVVPAEPRLPNLMRHMFGYRRISISDPIHVC

SEQ ID NO: 209 - protein, 865 aa, Sorghum bicolor
MSSSSLRRLCFVLPMDVDEAIPPASSDSEATSRRSRVTSTLEGYARATAGHLLSCFRRYRPCCRGGADRCHDSSGMAFEDIAGVVDEGVAGRKLAGAAGGGPRIFSYSELYIGTRGFSHGEVLGSGGFGRVYRAVLPSDGTTVAVKCVADSTGRFDKSFLAELAAVARLRHRNLVRLRGWCVRAGEELMLVYDYMPNRSLDRLLFAPPAKAKAPVPALSWDRRRRIVAGLAAALFYLHEQLDTQIIHRDVKTSNVMLDSEYNARLGDFGLARWLEHAVSADDAHVEVSPSPTSLRLSSSSPAASANYQFRLMDTSRIGGTIGYLPPESFQRRATGGTAKSDVFSFGIVLLEVATGRRAVDLAYPDDQIFMLDWVRRLSDEGKLLDAADAKLPDSGAGALFDDVGRVMHLGLLCSLHDPRARPTMRWVVENLSDGCSGGELPRLPSFVALPKYISLTTSSASDSGATTVTTDRSTATTSLSNPVYATAAADTIYHTAEDGSRAGSRSAGSGRRSSSRLSPVAAIPHVDMPREIPYKEIVAITNDFSESQVVAELDFGTGYEGFLDTGHGRVHVLVKRLGMKTCPALRVRFARELCNLAKLRHRNLVQLRGWCTDHGEMLVVYDYAPGSLLSHYLLQRRHGGAAVLPWRQRYSIVRALASAILYLHEEWDEQVIHRNITSSAVFLDPDMNPRLGSFALAEFLSRNEHGGHHVVVTASSAKGIFGYMSPEYMDTGEATTMADVYSFGVVVLEVVTGTMAVDGRLPEVLLVRKVQLFEQLNRPVEAMADQRLDGRFDRRELVRMARLGMACTRSDPAARPSMRKIVSILDGNDEVLDKFEQRKESTEDWQRRNATNLALVRRFQALGIH

SEQ ID NO: 210 - protein, 691 aa, Sorghum bicolor
MTGNLTQCHDKIKHEADINGNIKIFTEVEIERITRNFSTLIGKGGFGEVYMGILDDDNEPVAVKKYINEDLREVFMEEVRIHSKISHKNVVKLIGYCIEEHTLMIVMEYMSKGNLNDILHHSEILIPLDVRLGIAIGCAEALSYMHSMHLSFGNLVCHGDVKPANILLDDNLTAKLTDFGVSRLLVGGITRYTTTVKGSIEYMDPIYLQEGCLTPRSDVYSFGLVLCELIARKRVRKGDINLIGYVNKGSANGKGFREIFDSAIANENNMKILKEMKKLATECLSLSIYRRPQMIDVVKRLRIFRKELKDRHENYSESILASHHSWRKNNKQEMIMPTYNSKMQIRKSLGSFRRNLSNSKIQSEPSNVRIFTQEELKEVTHNYSYRLSGGTSGQVYKGTLEDNAVVAVRIFSEVLEGFEEAFINGGMILSQIFHRNIIKLLGYCSDCPAFVYEYAAKGSLSDVLDGHEHFPLDLRTKIAVKIAEALEYLHSSGAGIIRHGYVVPSKILLDDNFMPKLTGFSWARKFIKESNIIASDAITSHQLPSSGFYNDPIHDHCVSLKVRTDVYQFGVLLLTLISRKNFVFYADHDDLISQFRTACLTDGSGRAFFDDDIAAHSEDIFLLEEIGRLSLKCICEEIDQRPTMKEVAEHLRIITRSWKKCSSERTTLVSKTVSTSHIARAEGTKSNRPLD

SEQ ID NO: 211 - protein, 683 aa, Sorghum bicolor
MDSNIQFMTRMSFTEDEIEAITNNYGTLIGMGGFGEVYKGVLDDHYYVVAVKRYIRENLRKEFMEEVSIHSQMSHKNVVKFIGCCVGKSTLTLVTEYVPKGNLDDILHSSSAAIPLDIRLGIAIGCADALSYMHSMHLSIDSLICHGDIKPANILLDDNFTAKVSDFGLSRLLLGGITQYASKVIGSIDYMDPVLMHTGRLTPRNDVYSFGIVLLELVTRKRVKQGDMNLIGIFECAKGEGLRKLFDPSIANKNTIKILEEIVDLAMACLRLDIKNRPEMNHVEKRLRVLKRDLKCRQEASSQSILSTYHSWHTKDKQEKPQLKKSGSFFKRNASNAKIVSEFSNVRNFTKAELKEITDNYSHMLSGGMSAKFYKGTLEDNTVVAVRKFHDTDSQEAFINGGIVLSQIANKNNIIKLLGCCLEAETLAFIYEYADKGSLLDILGSQEYLPLDLRLRIAIKTAEALQYLHSSETGIIGHGSVSASTVLLHNNFVPKLTEFSGSSKLIMDSGSNAGQSVINSVLLEKVLYSDPSRYKTVLMNLESDVFRFGGVLLALVSRENSVSFDELIVEFTEAYQKDNSGKAMFDKDITAEQDIAALEEMGRLALRCTILNADEMARRPTMQEVAEELRRIRRCCKPGTSAAPHVTETTATAAAPLEPKLPNLMRHLFGYRRISSTDPIRTS

SEQ ID NO: 212 - protein, 796 aa, Sorghum bicolor
MKLEHTNIVRLMGYCYETKHVAIPYNGNVVLAEVATRALILEYLQNGSLETLLSTNADEELDWHTRYKIIKGICEGLNYMHEEIRPPVLHLDLKPDNILLDKNMVPKLADFGLSRICEGTQITSCLIGTRGYQPPEHIHRNLVSKKFDIFSLGVIMINIIEARHSDYYTSDDSDNFVDTVQMKWRSKLNGTYHGSLLDIYCKQVKICTEIALKCMEQKRNRRPTILEIIDKLNAMEHEMRMFENNQGRHIEREPRMIMPTSEGPIAGQLVVAHNFLLPAETEARPLRYSYSTTKGSTGLMLTELKRITDDFSENRKLGAGSFGKVYLGEKENGQKVAVKILDFDGLGPDAENFKDEFDNLMKVEHPNIVRLIDYCYETQYEAVPYNGRLIMTEKTTRALCLEYLHNGSLESHLPNEDLFDWHTRYRIIKGTCEGLKYIHNERQALHLNLKPSNILLDEHMVPKLGDLGMAEIFKGYIGTREYQPPEYIERRLISEKFDIFSLGIIILKIVAGKRGYSKYRGMNSEQFADDVQRIWRNRWDNGTLVGSILDTQCRQVKLCTEIALKCVEHKRIRRPNIVEIINKLDRMENKPCPPPPPGCVSANAPQESTHEPEGPEDTSAELQVRCGGPGSSSELLKVYPLQLRFPSTPNGGSPISSKLHLTNDTDGRVAFRLVSKGHPIRDFEGLTCGVVPPKSKLTLAVALRRPVSSGEWFELVSTRAGDGDLLLPQDRPPALDFLYQHSSFINRAKEAGREVHTVKLATIVVYTQTAVCFGPWFRFCRENLHRLFVDCFLPAW

SEQ ID NO: 213 - protein, 589 aa, Sorghum bicolor
MNLLEHKVEELIPGADKSRWMVHSNHNIRCFTKSEVEIITNSYRTMIGRGGFGEVFQGVLEDRGMVAVKRFINNVKDEDFAKELIVHREINHKNVVKLIGYCMEENALMMITEFIPNGNLSDVLHRDSGHISLDMRLRIATECAEAMAYMHSYMYTQVIHGDIKPANILKKATTKVWGVSIIDLCTDALSRGMRGVFDDKIANQDNMNILEGVAKLAGDCLRMERDRRPEMIAVAERLRRLRNASLQGQKRRDWFSWAMKSLPPAPPSPELYRKFSYAEMKAATQNFDKSLLVGKGEFGRVYRGMVDGSGTNVVAIKCLKRRHTVKIQPMLRHHHLVPVIGYCDEDEMILVYEYMAHGSLRDHLFEAHNSPLTRKSPLSWKQRLEICIGAARGLHYLHTCAEKDIIHRNVKLTNILLDNEWVAKISDNIETDPITDTICNAHGNIYDPEYDSTGRLTEKSDVFSFGAVLLEVLCAQPFLGKDCLLHWAVRCKKEGNLHQIVDCHLKRKMDPHSLFKFVETCEKCLANRSIGRPSMADVIADLEYALQLQESAEAGSRAGDAINLDLEVDSNNKDSMAWWYLSTSSSGSS

SEQ ID NO: 214 - protein, 764 aa, Hordeum vulgare
MLFSLTSRFHSQSPEDHSADPLIKCPSWRYYVLQMDREASSNRHGVLERMLLDESAEPTDLPLSLLEDITDRFSPDQEIGSGGFSVVYKGMIGKQMVAVKKLSNTVDITESKFHGEVKCLIKTKHKNIVRFLGYCADTQGKMAEYEGKLVMADVRNWLLCFEFVPKGSLDKHMSDASCGLEWRERYRIIRGICEGLHYLHEKRILHLDLKPANVLLDIGMVPKIADFGLSRCFDEGQTRAITQHLCGSQGYLAPEFYRGQIAFASDIYSLGVIIMEILTGAKGYFEEEDVVESWMNRLHQAPERHTQLEQVRVCTKIGIECMDLDPKKRPLVRHIIDRLDKTARAHYSCQTGMSSSLVKLQPSLLKEQSGEIIEKLADESFIKDINERPVTEDHCQQGQENADQWSSQKAQDTELKVNQPGTSIFGSKSSFLEKLQNLNIFSGKAHMNFLGNVSGLTIFTKAEIKNITKNNSVFLGPGRFCKVYKGTLPDNSVVAVKTYMALNDDMKQEFMMMINIHKELIHKNIIKLYGCCLEADIPTLVFEFAVNGNLWSILHHSKRKLPLDSRLGIAIGSAEGLRYMHSYANYSIQHGDVRPINIFLDDKLIPKIGNFAFSRLHNLQEEIRLEASESSDTSMLHDMGYLDLEFMGKGRVTQKSDVYSFGAILLELITRKRNVFDKNCVLTIEYRKLYEREKSGRAMFDKKIATENNDIFALEEIGKVAIECLKEDSKERPDMTEVMEQLMMIRRNRRLIKARNNAMTTSVP

SEQ ID NO: 215 - protein, 264 aa, Aegilops tauschii
  misc_feature (121)..(121): Xaa can be any naturally occurring amino acid
LGSGSFGDVYKGRLDDRRPVAVKRYKNGTKKEEFAKEVIVHSQINHKNVVRLLGCCTEEDALMIVMEFVCNGNLYNILHCSNADGPILFPLDKRLDIAIESAEALSCMHSMYSPVLHGDIXPANILLDEKYLPKLSDEFIARLLSTHEAQRTKTVIGCIGYVDPLFCQSGILTTKSDVYSFGVVLLEMITRKKATDGATSLTGCFAEAVGRGKKVRQLFDAEITYDKKKMKLVEEIVKLAVTCLRLDDKMRPTMVEVADRLRRI

SEQ ID NO: 216 - protein, 266 aa, Aegilops tauschii
GIVLGEGGFGKVYKGKLDNHRPVAVKIYKNGTKKEEFAKEVIVHSQINHKNVVRLFGCCTDVNALTIVMEFVCNGNLYNILHCCSSNANGSIPFPLDKRLDIAIESAEALSCMHSMYSPVLHGDIKPANILLDENLRPKISDFGIARLIAADETQHTRHVIGCIGYMDPLFCQSGILTPKSDVYSFGVVLLEIITRKKAVDGNIILAQTFAEAQRKGKKMRQMFDVEIANDKKNMKFLEGVAKLAVECLKMEAKVRPEMVEVADRL

SEQ ID NO: 217 - protein, 262 aa, Triticum urartu
LGEGGFGKVYKGKLDYLRPVAVKKYKNGTKKEEFAKEVIVHSQINHKNVVRLFGCCTEENALMIVMEFVCNGNLYNILHCSSDANGSVPFPLDKRLDIAIESAEVLSYMHSMYSPVLHGDIKPANILLDENLRPKISDFGIARLLAADETQHTRSVTGCIGYVDPLFCQSGILTPKSDVYSFGVVLLEIITRKKAVDGTIILAQNFAEALRKGKKVRQMFDEEIANDKKNMKFLEDVAKLAAECLKMEDKMRPEMVEVADRL

SEQ ID NO: 218 - protein, 269 aa, Triticum turgidum
VGKGAFGEVFRGFLDDGSPVAVKKYMNQNMKEGFDKEITIHCQVNHKNIVKLLGYCSEENALTMVTEYIPRGNLKDLLHGSDDPISFEARLRIAIDCADALAFMHSKDPPIIHGDIKPDNILLDDNLGAKLSDFGISRLLSMENSYFTNNVIGSRGYMDPEHIQTGRVDPKNDVYSFGVVLVELVTRAMAAQNGTCNDLAKKFIEAFLQKNIFLKVFGKQKKARREMFDTQIANASNMEVLEKIGELAIECLRRDIKKRPEMNHVVERL

SEQ ID NO: 219 - protein, 280 aa, Hordeum vulgare
FSEARIIVRGRHGIVYKGVLDNGQYIAVKKLHLMPGLDDEEFKNEFNNLMRVRHQNIIPLVYCHHTKQVLVEHNGKHVSARVEERYLCSEYLEGGSLDKHLSNEPCALAWYTCYKIIKGICDGLLCLHKCFQEPIWHLELKPTKILLDKDMMPKIGGFGGSRLFDSIETSSTSEVRGTSVYMPPEYISKRLITSSNVFSLGVIILQIMAGKESYTKCVDIPPEEFTERVYGFWVNRMPGTVSKHTSNEVKTCIEIALKCVESNRVNRPTINEIIQRMDKI

SEQ ID NO: 220 - protein, 285 aa, Hordeum vulgare
FSEKNIIGRGACGVIYKGVLDNGEEIAVKKLHQTLSIDDGLFKKEVNNVMRAEHKNIVRLVGYCHHISPIIVEHEGKHVSASVIERVICFEYMQRGSLDDQLSAESCKLDWDRCYKIKKGICEGLHYLHNAVPPIYHGDLEKPGNILLDKDMVAKIGDFGLSRVFDTTQTYMTTSGVIKGTPGYMSPEYINEHKISLKSDVFALGVIIIKMMTGKEDYSNYAHTPREEFIEHVCKKWWVKRLHATMRSHVFEEVRTCIGIALKCVEDDRTQRPTMAQILNELSNI

SEQ ID NO: 221 - protein, 207 aa, Aegilops tauschii
IEAISRLKHENVVQLLGYWVEGDEYVLAYEYTSGGTLHDILLSKGKKGVWGAKSRAALSWMQRVKIALSAAEGLEFLHHKEEPQVTHGNIISSNILLFDNDIAKVGNVGTANVLVREDIDSCHSFRQILDTHRIIDGLWFHQDDYHVDVYAATGQCNKKSDVYAFGAVLLELLTGRKAVDHTLPHGRQSLVTWLCTLGEKGLCTHCD

SEQ ID NO: 222 - protein, 282 aa, Arabidopsis thaliana
IGSSSLSTVYKGQLEDGTVIAVKVLNLKEFSAESDKWFYTEAKTLSQLKHRNLVKILGFAWESGKTKALVLPFMENGNLEDTIHGSAAPIGSLLEKIDLCVHIASGIDYLHSGYGFPIVHCDLKPANILLDSDRVAHVSDFGTARILGFREDGSTTASTSAFEGTIGYLAPEFAYMRKVTTKADVFSFGIIMMELMTKQRPTSLNDEDSQDMTLRQLVEKSIGNGRKGMVRVLDMELLGDSIVSLKDEEAIEDFLKLCLFCTSSRPEDRPDMNEILTHIMKL

SEQ ID NO: 223 - protein, 273 aa, Oryza sativa
GFGSFGKVFRGRLSNGMVVAIKVIHQHLEHAMRSFDTECRVLRMARHRNLIKILNTCSNLDFRALVLQYMPKGSLEALLHSEQGKQLGFLERLDIMLDVSMAMEYLHHEHYEVVLHCDLKPPSNVLFDDDMTAHVADFGIARLLLGDDNSMISASMPGTVGYMAPEYGTLGKASRKSDVFSYGIMLLEVFTAKKPTDAMFVGELNIRQWVQQAFPAELVHVVDCQLLQDGSSSSSSNMHDFLVPVFELGLLCSADSPEQRMAMSDVVLTLNKI

SEQ ID NO: 224 - protein, 297 aa, Sorghum bicolor
IGQGRYGSVYQGKLSPDGKSVAVKVFSLETRGAQKSFIAECSALRNVRHRNLVRILTACSSIHPNGNDFKALVYEFMSRGDLHNLLYSARDSEDSPCFIPLAQRLSIMVDVSEALAYLHHNHQGTIVHCDLKPSNILLDDNMVAQVGDFGLARFKIDSTASSFVDSSCTSSVAIKGTIGYIAPECAADGQASTAADVYSFGVILLEMFIRRSPTDEMFNDGMNIAKLAEINLSDNVLQIVDPQLLQEMSHSEDIPVTIRDSGEGILQSVLSIGLCCTKASPNERISMEEVAAKLHGI

SEQ ID NO: 225 - protein, 293 aa, Oryza sativa
LGSGSFGSVYKGKLNIQDHVAVKVLKLENPKALKSFTAECEALRNMRHRNLVKIVTICSSIDNRGNDFKAIVYDFMPSGSLEDWIHPETNDPADQRHLNLHRVTILLDVACALDYLHRHGPEPVVHCDVKSSNVLLDSDMVAHVGDFGLARILVDGTSLIQQSTSSMGFRGTIGYAAPEYGVGHIASTHGDIYSYGILVLEIVTGKRPTDSTFRPDLGLRQYVELGLHCRVTDVVDTKLILDSENWLNSTNNSPCRRITECIVSLLRLGLSCSQVLPLSRTPTGDIIDELNAI

SEQ ID NO: 226 - protein, 278 aa, Arabidopsis thaliana
IGSGNFGNVFKGLLGPENKLVAVKVLNLLKHGATKSFMAECETFKGIRHRNLVKLITVCSSLDSEGNDFRALVYEFMPKGSLDMWLQLEDLERVNDHSRSLTPAEKLNIAIDVASALEYLHVHCHDPVAHCDIKPSNILLDDDLTAHVSDFGLAQLLYKYDRESFLNQFSSAGVRGTIGYAAPEYGMGGQPSIQGDVYSFGILLLEMFSGKKPTDESFAGDYNLHSYTKSILSGCTSSGGSNAIDEGLRLVLQVGIKSEEYPRDRMRTDEAVRELISI

SEQ ID NO: 227 - protein, 269 aa, Oryza sativa
KLGQGGFGSVYLGTLPDGSRIAVKKLEGIGQGKKEFRSEVTIIGSIHHIHLVKLRGFCTEGPHRLLAYEYMANGSLDKWIFHSKEDDHLLDWDTRFNIALGTAKGLAYLHQDCDSKIVHCDIKPENVLLDDNFIAKVSDFGLAKLMTREQSHVFTTLRGTRGYLAPEWLTNYAISEKSDVYSYGMVLLEIIGGRKSYDPSEISEKAHFPSFAFKKLEEGDLQDIFDAKLKYNDKDGRVETAIKVALWCIQDDFYQRPSMSKVVQMLEGV

SEQ ID NO: 228 - protein, 268 aa, Nicotiana attenuata
KKLGRGGFGSVFEGCLEDGTKIAVKCLDGVGQVKKSFLAEVETIGSIHHVNLVQLIGFCAEKSHRLLVYEFMSNGSLEKWIYHGKQELTLDWNCRRKIIQDIAKGLAYLHEECRQKILHLDIKPPNILLDEKHNAKLSDFGLAKLIDRNQSQVMTMMRGTPGYLAPEWLSGAITEKVDVYSFGIVILEILSGRRHFEASESEEQQVMLNLFKKKAEEGQLVDLIDKHSEDMQLYKEEVIKTMQIAAWCLQRDYTKRPSMSMVVKAMEG

SEQ ID NO: 229 - protein, 266 aa, Nicotiana glutinosa
KLGEGGFGSVYEGTLSNGTKIVVKHLDGVGQVKDTFLTEVNTVGGIHHVNLVKLIGFCAEKSYRLLIYEYMVNGSLDRWIYHENGLTWLTRQGIISDIAKGLAYLHEDCSQKIIHLDINPQNILLDQHLNVKISDFGLSKLIEKDKSKVVTRMRGTPGYLAPEWLSSIITEKVDVYAFGIVLLEILCGRKNLDWSQADEEDVHLLRVFRRKAEEEQLMDMVDKNNEGMQLHKEEVMEMMSIAAWCLQGDYTKRPSMTWVVKALEGL

SEQ ID NO: 230 - protein, 273 aa, Arabidopsis thaliana
HVLGKGGFGTVYKGKLADSGRDVAVKILKVSEGNGEEFINEVASMSRTSHVNIVSLLGFCYEKNKRAIIYEFMPNGSLDKYISANMSTKMEWERLYDVAVGISRGLEYLHNRCVTRIVHFDIKPQNILMDENLCPKISDFGLAKLCKNKESIISMLHMRGTFGYIAPEMFSKNFGAVSHKSDVYSYGMVVLEMIGAKNIEKVEYSESNNGSMYFPEWVYKDFEKGEITRIFGNSITEEEEKFAKKLVLVALWCIQMNPSDRPPMIKVTEMLEG

SEQ ID NO: 231 - protein, 276 aa, Triticum aestivum
RFKEKVGQGGFGSVYKGELQNGVPVAVKMLENSTGEGEAFINEVATIGLIHHANIVQLLGFCSEGMRRALIYEFMPNESLEKYIFSRDSANFQHLLVPDKLLDIALGIARGMEYLHQGCNQRILHFDIKPHNILLDYNFNPKISDFGLAKLCARDQSIVTLTAARGKMGYIAPELYSRNFGGVSYKSDVYSFGMLVLEMVSGRRNSDPRIGSQDDVYLPEWIYEKVVNGEELALTLETTEEEKEKVRQLAIVALWCIQWNPRNRPSMTKVVNMLTG

SEQ ID NO: 232 - protein, 276 aa, Triticum aestivum
RFKEKVGQGGFGSVYKGKLQNGVPVAVKMLENSTGEGEAFINEVATIGLIHHANIVRLLGFCSEGMRRALIYEFMPNESLEKYIFSDDSNIFQNLLVPDKLLDIALGIARGMEYLHQGCNQRILHFDIKPHNILLDYNFNPKISDFGLAKLCARDQSIVTLTAARGTMGYIAPELYSRNFGGVSYKSDVYSFGMLVLEMVSGRRNSDPRIGSQDDVYLPEWIYEKVINGEELALTLETTQEEKEKVRQLAMVALWCIQWNPRNRPSMTKVVNMLTG

SEQ ID NO: 233 - protein, 276 aa, Triticum aestivum
RFKEKVGQGGFGSVYKGELPNGVPVAVKMLENSTGEGESFINEVATIGLIHHANIVRLLGFCSEGMRRALIYEFMPNESLEKYIFSDDSNIFQNLLVPEKLLDIALGIARGMEYLHQGCNQRILHFDIKPHNILLDYNFNPKISDFGLAKLCARDQSIVTLTAARGTMGYIAPELYSRNFGGVSYKADVYSFGMLVLEMVSGRRNSDPRIGSQDDVYLPEWIYEKVINGEELALTLETTQEEKDKVRQLAMVALWCIQWNPRNRPSMTKVVNMLTG

SEQ ID NO: 234 - protein, 276 aa, Triticum aestivum
RFKEKVGQGGFGSVYKGELPNGVPVAVKMLENSTGEGESFINEVATIGLIHHANIVRLLGFCSEGMRRALIYEFMPNESLEKYIFSDDSNIFQNLLVPEKLLDIALGIARGMEYLHQGCNQRILHFDIKPHNILLDYNFNPKISDFGLAKLCARDQSIVTLTAARGTMGYIAPELYSRNFGGVSYKSDVYSFGMLVLEMVSGRRNSDPRIGSQDDVYLPEWIYEKVINGEELALTLETTQEEKDKVSQLAMVALWCIQWNPSNRPSMTKVVNMLTG

SEQ ID NO: 235 - protein, 264 aa, Arabidopsis thaliana
KIGQGGFGAVYYAELRGEKAAIKKMDMEASKQFLAELKVLTRVHHVNLVRLIGYCVEGSLFLVYEYVENGNLGQHLHGSGREPLPWTKRVQIALDSARGLEYIHEHTVPVYVHRDIKSANILIDQKFRAKVADFGLTKLTEVGGSATRGAMGTFGYMAPETVYGEVSAKVDVYAFGVVLYELISAKGAVVKMTEAVGEFRGLVGVFEESFKETDKEEALRKIIDPRLGDSYPFDSVYKMAELGKACTQENAQLRPSMRYIVVAL

The invention claimed is:

1. A DNA molecule comprising a nucleic acid sequence with at least 85% identity to SEQ ID NO: 1 and encoding a protein with at least 85% amino acid sequence identity to SEQ ID NO: 2 that confers resistance to Stripe Rust (Pst) to a cereal plant.

2. The DNA molecule of claim 1, wherein said molecule encodes the amino acid sequence of SEQ ID NO: 2.

3. The DNA molecule of claim 1, wherein said nucleic acid sequence comprises SEQ ID NO: 6 and SEQ ID NO: 7.

4. The DNA molecule of claim 1, wherein said nucleic acid sequence encodes SEQ ID NO: 4 and SEQ ID NO: 5.

5. An artificial vector comprising the DNA molecule of claim 1 and a heterologous nucleic acid sequence.

6. The artificial vector of claim 5, further comprising at least one nucleic acid sequence with at least 85% identity to a tandem kinase-pseudokinase (TKP)-containing gene.

7. A transgenic plant or cell thereof, comprising the DNA molecule of claim 1.

8. The transgenic plant or cell thereof of claim 7, wherein the plant is a cereal plant.

9. The transgenic plant or cell thereof of claim 8, wherein said cereal plant is any one of barley, rye, triticale, oat, wheat, rice and maize.

10. A method of conferring resistance to Pst to a cereal plant or cereal cell thereof, the method comprising at least one of:
   a. expressing in a cell of said plant at least one DNA molecule of claim 1, and
   b. converting at least one wtk1 non-functional allele of a cell of said plant into a functional Wtk1 gene;
   thereby conferring resistance to Pst to the cereal plant or the cereal cell thereof.

11. A method for detecting a Wtk1 gene in an ex vivo sample from a cereal plant, comprising:
   c. providing nucleic acids isolated from said sample;
   d. detecting a nucleic acid molecule comprising at least 85% identity to SEQ ID NO: 1, encoding a protein with at least 85% identity to SEQ ID NO: 2 in said provided nucleic acids; and
   e. confirming said detected nucleic acid molecule confers resistance to Pst;
   thereby, detecting a Wtk1 gene in a sample.

12. The method of claim 11, wherein detecting comprises detecting a nucleic acid molecule comprising SEQ ID NO: 1 in said provided nucleic acids.

13. The method of claim 11, wherein said detecting comprises:

a. hybridizing at least one nucleic acid molecule to said provided nucleic acid molecules, wherein said at least one nucleic acid molecule comprises a region with 100% complementarity to said nucleic acid molecule comprising at least 85% identity to SEQ ID NO: 1, encoding a protein with at least 85% identity to SEQ ID NO: 2 and conferring resistance to Pst; and b. detecting said hybridizing, wherein the presence of said hybridizing indicates the presence of a functional Wtk1 gene in said sample.

14. The DNA molecule of claim 1, wherein said protein does not comprise a serine at position 54, a lysine at position 114, a lysine at position 150, a leucine at position 161, a leucine at position 211, a threonine at position 460, an asparagine at position 524, an isoleucine a position 562, a serine at position 591 or a methionine at position 614.

* * * * *